US010226527B2

(12) United States Patent
Tharakaraman et al.

(10) Patent No.: US 10,226,527 B2
(45) Date of Patent: Mar. 12, 2019

(54) HEMAGGLUTININ POLYPEPTIDES, AND REAGENTS AND METHODS RELATING THERETO

(75) Inventors: Kannan Tharakaraman, Arlington, MA (US); Karthik Viswanathan, Waltham, MA (US); Rahul Raman, Waltham, MA (US); Ram Sasisekharan, Cambridge, MA (US)

(73) Assignee: MASSACHUSETTS INSTITUTE OF TECHNOLOGY, Cambridge, MA (US)

( * ) Notice: Subject to any disclaimer, the term of this patent is extended or adjusted under 35 U.S.C. 154(b) by 0 days.

(21) Appl. No.: 13/253,060

(22) Filed: Oct. 4, 2011

(65) Prior Publication Data
US 2012/0213819 A1   Aug. 23, 2012

Related U.S. Application Data

(60) Provisional application No. 61/389,639, filed on Oct. 4, 2010.

(51) Int. Cl.
*A61K 39/145* (2006.01)
*C12N 7/00* (2006.01)
*A61K 39/12* (2006.01)

(52) U.S. Cl.
CPC ............ *A61K 39/145* (2013.01); *A61K 39/12* (2013.01); *C12N 7/00* (2013.01); *C12N 2760/16134* (2013.01)

(58) Field of Classification Search
None
See application file for complete search history.

(56) References Cited

U.S. PATENT DOCUMENTS

| 4,166,452 | A | 9/1979 | Generales, Jr. |
| 4,270,537 | A | 6/1981 | Romaine |
| 4,596,556 | A | 6/1986 | Morrow et al. |
| 4,692,411 | A | 9/1987 | Ghose |
| 4,790,824 | A | 12/1988 | Morrow et al. |
| 4,816,567 | A | 3/1989 | Cabilly et al. |
| 4,886,499 | A | 12/1989 | Cirelli et al. |
| 4,940,460 | A | 7/1990 | Casey et al. |
| 4,941,880 | A | 7/1990 | Burns |
| 5,015,235 | A | 5/1991 | Crossman |
| 5,064,413 | A | 11/1991 | McKinnon et al. |
| 5,141,496 | A | 8/1992 | Dalto et al. |
| 5,190,521 | A | 3/1993 | Hubbard et al. |
| 5,312,335 | A | 5/1994 | McKinnon et al. |
| 5,328,483 | A | 7/1994 | Jacoby |
| 5,334,144 | A | 8/1994 | Alchas et al. |
| 5,339,163 | A | 8/1994 | Homma et al. |
| 5,383,851 | A | 1/1995 | McKinnon, Jr. et al. |
| 5,417,662 | A | 5/1995 | Hjertman et al. |
| 5,466,220 | A | 11/1995 | Brenneman |
| 5,480,381 | A | 1/1996 | Weston |
| 5,500,161 | A | 3/1996 | Andrianov et al. |
| 5,503,627 | A | 4/1996 | McKinnon et al. |
| 5,520,639 | A | 5/1996 | Peterson et al. |
| 5,527,288 | A | 6/1996 | Gross et al. |
| 5,569,189 | A | 10/1996 | Parsons |
| 5,599,302 | A | 2/1997 | Lilley et al. |
| 5,649,912 | A | 7/1997 | Peterson |
| 5,698,390 | A | 12/1997 | Houghton et al. |
| 5,704,911 | A | 1/1998 | Parsons |
| 5,893,397 | A | 4/1999 | Peterson et al. |
| 5,993,412 | A | 11/1999 | Deily et al. |
| 7,981,429 | B2 * | 7/2011 | Yang et al. ................. 424/206.1 |
| 8,039,002 | B2 * | 10/2011 | Yang et al. ................. 424/206.1 |
| 2005/0009008 | A1 | 1/2005 | Robinson et al. |
| 2008/0241918 | A1 | 10/2008 | Sasisekharan et al. |
| 2009/0269342 | A1 | 10/2009 | Sasisekharan et al. |
| 2010/0004195 | A1 | 1/2010 | Sasisekharan et al. |
| 2011/0033490 | A1 | 2/2011 | Jayaraman et al. |
| 2014/0335504 | A1 | 11/2014 | Sasisekharan et al. |

FOREIGN PATENT DOCUMENTS

| CN | 101553502 A | 10/2009 |
| JP | 2010-500880 A | 1/2010 |
| WO | WO-9111465 A1 | 8/1991 |
| WO | WO-9713537 A1 | 4/1997 |
| WO | WO-9737705 A1 | 10/1997 |
| WO | WO-9934850 A2 | 7/1999 |
| WO | WO-2002000885 | 1/2002 |
| WO | WO-2005020889 | 3/2005 |
| WO | WO-2005/116258 A2 | 12/2005 |
| WO | WO-2006108226 | 10/2006 |

(Continued)

OTHER PUBLICATIONS

Navakul, Thesis: Effect of Antigenic Site Mutation on Cell Receptor Binding of Influenza A Virus (H%N1) Hemagglutinin, Feb. 2012. Due to size, only the relevant pages have been provided. The entire Thesis can be found at http://dric.nrct.go.th/direct_fulltext.php?bid=DRL003360&file=50640200.pdf.*
Navakul, Effect of Antigenic Site Mutation on Cell Receptor Binding of Influenza A Virus (H%N1) Hemagglutinin, 13th Annual Symposium on Computational Science and Engineering (ANSCE 13), Mar. 25-27, 2009.*
Ribi, et al., "Modulation of Humoral and Cell-Mediated Immune Response," Immunobiology and Immunopharmacology of Bacterial Endotoxins 407-420 (1986).
Chandrasekaran et al., Glycan topology determines human adaptation of avian H5N1 virus hemagglutinin, Nature Biotechnology 26(1): 107-113 (2008).
PCT/ISA/206 Invitation to Pay Additional Fees, and Where Applicable, Protest Fee, for PCT/US2011/054831, 11 pages (dated Dec. 12, 2012).

(Continued)

Primary Examiner — Nicole Kinsey White
(74) Attorney, Agent, or Firm — Choate, Hall & Stewart LLP; Brenda Herschbach Jarrell

(57) ABSTRACT

The present invention provides a system for analyzing interactions between glycans and interaction partners that bind to them. The present invention also provides HA polypeptides that bind to umbrella-topology glycans, and reagents and methods relating thereto.

12 Claims, 54 Drawing Sheets

Specification includes a Sequence Listing.

(56) References Cited

FOREIGN PATENT DOCUMENTS

| | | |
|---|---|---|
| WO | WO-2007/051036 A2 | 5/2007 |
| WO | WO 2007/092792 * | 8/2007 |
| WO | WO-2007130327 | 11/2007 |
| WO | WO-2007130330 | 11/2007 |
| WO | WO-2008005777 | 1/2008 |
| WO | WO-2008/021959 A2 | 2/2008 |
| WO | WO-2008040060 | 4/2008 |
| WO | WO-2008/052173 A2 | 5/2008 |
| WO | WO-2008054535 | 5/2008 |
| WO | WO-2008061243 | 5/2008 |
| WO | WO-2008073161 | 6/2008 |
| WO | WO-2008 087563 A2 | 7/2008 |
| WO | WO-2008094197 | 8/2008 |
| WO | WO-2008094200 | 8/2008 |
| WO | WO-2008 112017 A2 | 9/2008 |
| WO | WO-2008148104 | 12/2008 |
| WO | WO-2009009876 | 1/2009 |
| WO | WO-2009012489 | 1/2009 |
| WO | WO-2009 089121 A2 | 7/2009 |
| WO | WO-2009089121 | 7/2009 |
| WO | WO-2010006452 | 1/2010 |
| WO | WO-2012/047941 A2 | 4/2012 |
| WO | WO-2014/124319 A2 | 8/2014 |

OTHER PUBLICATIONS

Allison, A.C., "The Mode of Action of Immunological Adjuvants," Dev. Biol. Stand., 92:3-11 (1998).
Altschul, S.F., et al., "Basic Local Alignment Search Tool," J. Mol. Biol., 215(3):403-410 (1990).
Altschul, S.F., et al., "Gapped BLAST and PSI-BLAST: a new generation of protein database search programs", Nucleic Acids Research, 25(17):3389-3402 (1997).
Basler, C., et al., "Influenza Viruses," Wiley Encyclopedia of Molecular Medicine, vol. 3, New York: John Wiley and Sons, pp. 1741-1747 (2002).
Baxevanis, A.D., et al., Bioinformatics : A Practical Guide to the Analysis of Genes and Proteins, Wiley, 1998.
Baylor, N.W., et al., "Aluminum salts in vaccines—US perspective," Vaccine, 20:S18-S23 (2002).
Bresson, J.L., et al., "Safety and immunogenicity of an inactivated split-virion influenza A/Vietnam/1194/2004 (H5N1) vaccine: phase I randomised trial," Lancet, 367:1657-1664 (2006).
Cao, M., et al., "Enhancement of the protective effect of inactivated influenza virus vaccine by cytokines," Vaccine, 10(4):238-241 (1992).
Chandrasekaran, A., et al., "Glycan topology determines human adaptation of avaian H5N1 virus hemagglutinin," Nature Biotechnology, 26:107-113 (2008).
Childs, R.A., et al., "Receptor-binding specificity of pandemic influenza A (H1N1) 2009 virus determined by carbohydrate microarray," Nature Biotechnology, 27(9):797-799 (2009).
Connor, R.J., et al., "Receptor Specificity in Human, Avian, and Equine H2 and H3 Influenza Virus Isolates," Virology, 205:17-23 (1994).
Cooper, C.L., et al., "Safety and immunogenicity of CPG 7909 injection as an adjuvant to Fluarix influenza vaccine," Vaccine, 22:3136-3143 (2004).
Eisen, M.B., et al., "Binding of the Influenza A Virus to Cell-Surface Receptors: Structures of Five Hemagglutinin-Sialyloligosaccharide Complexes Determined by X-Ray Crystallography," Virology, 232:19-31 (1997).
Enserink, M., "'Pandemic Vaccine' Appears to Protect Only at High Doses," Science, 309:996 (2005).
Fishwild, D.M., et al., "High-avidity human IgGk monoclonal antibodies from a novel strain of minilocus transgenic mice," Nature Biotechnology, 14(7):845-851 (1996).
Gambaryan, A.S., et al., "Differences Between Influenza Virus Receptors on Target Cells of Duck and Chicken and Receptor Specificity of the 1997 H5N1 Chicken and Human Influenza Viruses from Hong Kong," Avian Diseases, 47:1154-1160 (2003).
Gamblin, S.J., et al., "The Structure and Receptor Binding Properties of the 1918 Influenza Hemagglutinin," Science, 303:1838-1842 (2004).
Ghockhikyan, A., et al., "Prototype Alzheimer's disease epitope vaccine induced strong Th2-type anti-Aβ antibody response with Alum to Quil A adjuvant switch," Vaccine, 24:2275-2282 (2006).
Glaser, L., et al., "A Single Amino Acid Substitution in 1918 Influenza Virus Hemagglutinin Changes Receptor Binding Specificity," Journal of Virolology, 79(17):11533-11536 (2005).
Glaser, L., et al., "Sequence analysis and receptor specificity of the hemagglutinin of a recent influenza H2N2 virus isolated from chicken in North America," Glycoconj J., 23:93-99 (2006).
Ha, Y., et al., "X-ray structure of the hemagglutinin of a potential H3 avian progenitor of the 1968 Hong Kong pandemic influenza virus," Virology, 309:209-218 (2003).
Ha, Y., et al., "X-ray structures of H5 avian and H9 swine influenza virus hemagglutinins bound to avian and human receptor analogs," PNAS, 98(20):11181-11186 (2001).
Harlow, E., et al., Antibodies: A Laboratory Manual, Cold Spring Harbor Laboratory (1988).
Hensley, S,E., et al., "Hemagglutinin Receptor Binding Avidity Drives Influenza A Virus Antigenic Drift," Science, 326:734-736 (2009).
Hoogenboom, H.R., et al., "Construction and Expression of Antibody-Tumor Necrosis Factor Fusion Proteins," Molecular Immunology, 28(9):1027-1037 (1991).
Imberty, A., et al., An Unusual Carbohydrate Binding Site Revealed by the Structures of Two Maackia amurensis Lectins Complexed with Sialic Acid-containing Oligosaccharides, Journal of Biological Chemistry, 275(23):17541-17548 (2000).
Itoh, Y., et al., "In vitro and in vivo characterization of new swine-origin H1N1 influenza viruses," Nature, 460:1021-1025 (2009).
Jayasena, S.D., "Aptamers: An Emerging Class of Molecules That Rival Antibodies in Diagnostics," Clinical Chemistry, 45(9):1628-1650 (1999).
Katz, J.M., et al., "A nonionic block co-polymer adjuvant (CRL1005) enhances the immunogenicity and protective efficacy of inactivated influenza vaccine in young and aged mice," Vaccine, 18:2177-2187 (2000).
Kreuter, J., et al., "Long-Term Studies of Microencapsulated and Adsorbed Influenza Vaccine Nanoparticles," Journal of Pharmaceutical Science, 70(4):367-371 (1981).
Liu, J., et al., "Structures of receptor complexes formed by hemagglutinins from the Asian Influenza pandemic of 1957," PNAS, 106(40):17175-17180 (2009).
Lonberg, N., et al., "Antigen-specific human antibodies from mice comprising four distinct genetic modifications," Nature, 368:856-859 (1994).
Lonberg, N., et al., "Human Antibodies from Transgenic Mice," Intern. Rev. Immunol., 13(1):65-93 (1995).
Losman, M.J., et al., "Baboon Anti-Idiotype Antibodies Mimic a Carcinoembryonic Antigen Epitope," Int. J. Cancer, 46:310-314 (1990).
Ma, W., et al., "Identification of H2N3 influenza A viruses from swine in the United States," PNAS, 104(52):20949-20954 (2007).
Maines, T.,R., et al., "Transmission and Pathogenesis of Swine-Origin 2009 A(H1N1) Influenza Viruses in Ferrets and Mice," Science, 325:484-487 (2009).
Maines, T.R., et al., "Lack of transmission of H5N1 avian-human reassortant influenza viruses in a ferret model," PNAS, 103(32):12121-12126 (2006).
Makarova, N.V., et al., "Transmission of Eurasian avian H2 influenza virus to shorebirds in North America," Journal of General Virology, 80:3167-3171 (1999).
Marks, J.D., et al., "By-Passing Immunization: Building High Affinity Human Antibodies by Chain Shuffling," Biotechnology, 10:779-783 (1992).
Marks, J.D., et al., "By-passing Immunization: Human Antibodies from V-gene Libraries Displayed on Phage," J. Mol. Biol., 222:581-597 (1991).

(56) References Cited

OTHER PUBLICATIONS

Mbwuike, I.N., et al., "Enhancement of the protective efficacy of inactivated influenza A virus vaccine in aged mice by IL-2 liposomes," Vaccine, 8:347-352 (1990).
Milstein, C., et al., "Hybrid hybridomas and their use in immunohistochemistry," Nature 305:537-540 (1983).
Misener, et al., (eds.), Bioinformatics Methods and Protocols (Methods in Molecular Biology, vol. 132), Humana Press, 1999.
Mostow, S.R., et al., "Application of the Single Radial Diffusion Test for Assay of Antibody to Influenza Type A Viruses," Journal of Clinical Microbiology, 2(6):531-540 (1975).
NCBI website, protein Blast of GenBank record No. ABW74701.1 (GI:158604860), Influenza A virus (A/Indonesia/TLL001/2006(H5N1)), (http://blast.ncbi.nlm.nih.gov/Blast.cigi), Oct. 28, 2011.
Nicholson, K.G., et al., Textbook of Influenza, Blackwell Science, Malden, MA, 1998.
Pappas, C., et al., "Receptor Specificity and Transmission of H2N2 Subtype Viruses Isolated from the Pandemic of 1957," PLoS One, 5(6):e11158 (10 pages) (2010).
Payne, L.G., et al., "Poly[di(carboxylataphenoxy)phosphazene] (PCPP) is a potent immunoadjuvant for an influenza vaccine," Vaccine, 16(1):92-98 (1998).
Phillips, N.C., et al., "Enhanced antibody response to liposome-associated protein antigens: preferential stimulation of IgG2a/b production," Vaccine, 10:151-158 (1992).
Reisfeld R.A., et al., "Human tumour-associated antigens: targets for monoclonal antibody-mediated cancer therapy," Cancer Surveys, 4(1):271-290 (1985).
Remington Pharmaceutical Sciences, 19th ed., Mack Publishing Co., Easton, PA, 1995.
Remington the Science and Practice of Pharmacy, 21st ed., Lippincott, Williams & Wilkins, Baltimore, MD, 2006.
Riechmann, L., et al., "Reshaping human antibodies for therapy," Nature, 332:323-327 (1988).
Rogers, G.N., et al., "Single amino acid substitutions in influenza haemagglutinin change receptor binding specificity," Nature, 304:76-78 (1983).
Rogers, G.N., et al., "Receptor Determinants of Human and Animal Influenza Virus Isolates: Differences in Receptor Specificity of the H3 Hemagglutinin Based on Species of Origin," Virology, 127:361-373 (1983).
Russell, C.J., et al., "The Genesis of a Pandemic Influenza Virus," Cell, 123:368-371 (2005).
Russell, R.J., et al., "Avian and human receptor binding by hemagglutinins of influenza A viruses," Glyconconj J., 23:85-92 (2006).
Russell, R.J., et al., "H1 and H7 influenza haemagglutinin structures extend a structural classification of haemagglutinin subtypes," Virology, 325:287-296 (2004).
Sambrook et al., Molecular Cloning: A Laboratory Manual, CSHL Press, Sections 7.71-7.77 (1989).
Sauter, N.K., et al., "Binding of Influenza Virus Hemagglutinin to Analogs of Its Cell-Surface Receptor, Sialic Acid: Analysis by Proton Nuclear Magnetic Resonance Spectroscopy and X-ray Crystallography," Biochemistry, 31:9609-9621 (1992).
Schafer, J.R., et al., "Origin of the Pandemic 1957 H2 Influenza A Virus and the Persistence of Its Possible Progenitors in the Avian Reservoir," Virology, 194 781-788 (1993).
Schild, G.C., et al., "Single-radial-haemolysis: a new method for the assay of antibody to influenza haemagglutinin," Bull. World Health Organ., 52:43-50 & 223-31, (1975).
Shinya, K., et al., "Influenza virus receptors in the human airway: Avian and human flu viruses seem to target different regions of a patent's respiratory tract," Nature, 440: 435-436 (2006).
Shriver, Z., et al., "Context-Specific Target Definition in Influenza A Virus Hemagglutinin-Glycan Receptor Interactions," Chemistry & Biology, 16:803-814 (2009).
Skehel, J.J., et al., "Receptor Binding and Membrane Fusion in Virus Entry: The Influenza Hemagglutinin," Annu. Rev. Biochem., 69:531-569 (2000).
Srinivasan, A., et al., "Quantitative biochemical rationale for differences in transmissibility of 1918 pandemic influenza A viruses," PNAS, 105(8):2800-2805 (2008).
Stevens, J., et al., "Recent avian H5H1 viruses exhibit increased propensity for acquiring human receptor specificity," J. Mol. Biol., 381(5):1382-1394 (2008).
Stevens, J., et al., "Structure and Receptor Specificity of the Hemagglutinin from an H5H1 Influenza Virus," Science, 312:404-410 (2006).
Stevens, J., et al., "Structure of the Uncleaved Human H1 Hemagglutinin from the Extinct 1918 Influenza Virus," Science, 303:1866-1870 (2004).
Stevens, J., et. al., "Glycan Microarray Analysis of the Hemagglutinins from Modern and Pandemic Influenza Viruses Reveals Different Receptor Specificities," J. Mol. Biol., 355:1143-1155 (2006).
Stevens, J.M., et. al., "Glycan microarray technologies: tools to survey host specificity of influenza viruses," Nature Reviews Microbiology, 4:857-864 (2006).
Treanor, J.J., et al., "Safety and Immunogenicity of an Inactivated Subvirion Influenza A (H5N1) Vaccine," N. Eng J. Med., 354(13):1343-1351 (2006).
Tuerk, C., et al., "Systematic Evolution of Ligands by Exponential Enrichment: RNA Ligands to Bacteriophage T4 DNA Polymerase," Science, 249:505-510 (1990).
Tumpey et al., "Characterization of the Reconstructed 1918 Spanish Influenza Pandemic Virus," Science, 310:77-80 (2005).
Tumpey, T.M., et al., "A Two-Amino Acid Change in the Hemagglutinin of the 1918 Influenza Virus Abolishes Transmission" Science, 315:655-659 (2007).
Unkeless, J.C., et al., "Structure and Function of Human and Murine Receptors for IgG," Ann. Rev. Immunol., 6:251-281 (1988).
Van Hoeven, N., et al., "Human HA and polymerase subunit PB2 proteins confer transmission of an avian influenza virus through the air," PNAS, 106(9):3366-3371 (2009).
Van Riel, D., et al., "Human and Avian Influenza Viruses Target Different Cells in the Lower Respiratory Tract of Humans and Other Mammals," The American Journal of Pathology, 171(4):1215-1223 (2007).
Verhoeyen, M., et al., "Reshaping Human Antibodies: Grafting an Antilysozyme Activity," Science, 239:1534-1536 (1988).
Wan, H., et al., "Replication and Transmission of H9N2 Influenza Viruses in Ferrets: Evaluation of Pandemic Potential, "PLoS ONE, 3(8):e2923 (13 pages) (2008).
Wang, K., et al., "Expression and purification of an influenza hemagglutinin—one step closer to a recombinant protein-based influenza vaccine," Vaccine, 24:2176-2185 (2006).
Wei, C.J., et al., "Cross-Neutralization of 1918 and 2009 Influenza Viruses: Role of Glycans in Viral Evolution and Vaccine Design," Science Translation Medicine, 2(24):24ra21 (8 pages) (2010).
Weiss, S.M., Predictive Data Mining—A Practical Guide, Morgan Kaufmann, San Francisco, CA (1998).
Xu, D., et al., "Distinct Glycan Topology for Avian and Human Sialopentasaccharide Receptor Analogues Upon Binding Different Hemagglutinins: A Molecular Dynamics Perspective," J. Mol. Biol., 387:465-491 (2009).
Xu, R., et al., "Structure, Receptor Binding and Antigenicity of Influenza Virus Hemagglutinins from the 1957 H2N2 Pandemic," J. Virol., 84(4):1715-1721 (2010).
Yamada, S., et al., "Haemagglutinin mutations responsible for the binding of H5N1 influenza A viruses to human-type receptors," Nature, 444:378-382 (2006).
Yang, Z.Y., et al., "Immunization by Avian H5 Influenza Hemagglutinin Mutants with Altered Receptor Binding Specificity," Science, 317:825-828 (2007).
Yen, H.L., et al., "Pandemic Influenza as a Current Threat," Curr. Top. Microb. Immunol., 333:3-24 (2009).
International Search Report for PCT/US2011/054831, 9 pages (dated Feb. 19, 2013).
Written Opinion for PCT/US2011/054831, 17 pages (dated Feb. 19, 2013).

(56) References Cited

OTHER PUBLICATIONS

Ferreira, H. et al., Identification of a Dominant Epitope in the Hemagglutinin of an Asian Highly Pathogenic Avian Influenza H5N1 Clade 1 Virus by Selection of Escape Mutants, Avian Diseases, 54: 565-571 (2010).
Shriver, Z. et al., Context-Specific Target Definition in influenza A Virus Hemagglutinin-Glycan Receptor Interactions, Chemistry & Biology Review, 16: 803-814 (2009).
Aich, U. et al., Glycomics-based analysis of chicken red blood cells provides insight into the selectivity of the viral agglutination assay, The FEBS Journal, 278(10):1699-1712 (2011).
Belser, J.A. et al., Effect of D222G mutation in the hemagglutinin protein on receptor binding, pathogenesis and transmissibility of the 2009 pandemic H1N1 influenza virus, PLoS One, 6(9):e25091, 8 pages (2011).
Hobbie, S.N. et al., Modular glycosphere assays for high-throughput functional characterization of influenza viruses, BMC Biotechnology, 13:34, 8 pages (2013).
Jayaraman, A. et al., A single base-pair change in 2009 H1N1 hemagglutinin increases human receptor affinity and leads to efficient airborne viral transmission in ferrets, PLoS One, 6(3):e17616, 8 pages (2011).
Jayaraman, A. et al., Decoding the distribution of glycan receptors for human-adapted influenza A viruses in ferret respiratory tract, PLoS One, 7(2):e27517, 8 pages (2012).
Jayaraman, A. et al., Glycosylation at Asn91 of H1N1 haemagglutinin affects binding to glycan receptors, The Biochemical Journal, 444(3):429-435 (2012).
Lakdawala, S.S. et al., Receptor specificity does not affect replication or virulence of the 2009 pandemic H1N1 influenza virus in mice and ferrets, Virology, 446(1-2):349-356 (2013).
Maines, T.R. et al., Effect of receptor binding domain mutations on receptor binding and transmissibility of avian influenza H5N1 viruses, Virology, 413(1):139-147 (2011).
Pearce, M.B. et al., Pathogenesis and transmission of swine origin A(H3N2)v influenza viruses in ferrets, Proceedings of the National Academy of Science, 109(10):3944-3949 (2012).
Sassaki, G.L. et al., Human ($\alpha 2 \rightarrow 6$) and avian ($\alpha 2 \rightarrow 3$) sialylated receptors of influenza A virus show distinct conformations and dynamics in solution, Biochemistry, 52(41):7217-7230 (2013).
Soundarajan, V. et al., Extrapolating from sequence—the 2009 H1N1 'swine' influenza virus, Nature Biotechnology, 27(6):510-513 (2009).
Soundarajan, V. et al., Networks link antigenic and receptor-binding sites of influenza hemagglutinin: mechanistic insight into fitter strain propagation, Scientific Report, 1:200 (2011).
Srinivasan, A. et al., Quantitative characterization of glycan-receptor binding of H9N2 influenza A virus hemagglutinin, PLoS One, 8(4):e59550, 8 pages (2013).
Srinivasan, A. et al., Quantitative description of glycan-receptor binding of influenza A virus H7 hemagglutinin, PLoS One, 8(2):e49597, 7 pages (2013).
Sun, X. et al., N-linked glycosylation of the hemagglutinin protein influences virulence and antigenicity of the 1918 pandemic and seasonal H1N1 influenza A viruses, Journal of Virology, 87(15):8756-8766 (2013).
Tharakaraman, K. et al., Antigenically intact hemagglutinin in circulating avian and swine influenza viruses and potential for H3N2 pandemic, Scientific Reports, 3:1822, 9 pages (2013).
Tharakaraman, K. et al., Glycan receptor binding of the influenza A virus H7N9 hemagglutinin, Cell, 153(7):1486-1493 (2013).
Tharakaraman, K. et al., Structural determinants for naturally evolving H5N1 hemagglutinin to switch its receptor specificity, Cell, 153(7):1475-1485 (2013).
Viswanathan, K. et al., Glycans as receptors for influenza pathogenesis, Glycoconjugate Journal, 27(6):561-570 (2010).

Abdel-Moneim, A.S. et al., Isolation and characterization of highly pathogenic avian influenza virus subtype H5N1 from donkeys, J. Biomed. Sci., 17:25, 6 pages (2010).
Burke, D.F. and Smith, D.J., A recommended numbering scheme for influenza A HA subtypes, PLoS One, 9(11):e112302, 6 pages (2014).
GenBank Accession No. AY818135.1, GI: 58618437, first referenced Feb. 9, 2005 (3 pages).
GenBank Accession No. CY041936.1, GI: 251757571, first referenced Jul. 7, 2009 (4 pages).
Ma, E.J., What is the history of the H3 numbering system? Ericmajinglonj.com, 9 pages, last accessed Jan. 29, 2016 <http://www.ericmajinglong.com/2014/06/16/what-is-the-history-of-the-h3-numbering-system/>.
Nobusawa, E. et al., Comparison of complete amino acid sequences and receptor-binding properties among 13 serotypes of hemagglutinins of influenza A viruses, Virology, 182(2):475-85 (1991).
Nwe, N. et al., Expression of hemagglutinin protein from the avian influenza virus H5N1 in a baculovirus/insect cell system significantly enhanced by suspension culture, BMC Microbiol., 6:16, 7 pages (2006).
Winter, G. et al., Nucleotide sequence of the haemagglutinin gene of a human influenza virus H1 subtype, Nature, 292(5818):72-5 (1981).
Written Opinion for PCT/US2014/015397, 3 pages (dated May 7, 2014).
Ayora-Talavera, G. et al., Mutations in H5N1 influenza virus hemagglutinin that confer binding to human tracheal airway epithelium, PLoS One, 4(11):e7836 (2009).
Hu, W., Quantifying the effects of mutations on receptor binding specificity of influenza viruses, J. Biomedical Science and Engineering, vol. 3, pp. 227-240 and introduction (2010).
Imai, M. et al., Experimental adaptation of an influenza H5 HA confers respiratory droplet transmission to a reassortant H5 HA/H1N1 virus in ferrets, Nature, 486(7403):420-8 (2012).
Samukov, V.V. et al., Antigenic properties of synthetic fragments of the heavy chain of influenza virus A hemagglutinin, Mol. Gen. Mikrobiol. Virusol., (7):35-9 (1988). [Russian, with English translation].
EBI Accession No. UNITPROT: Q5EP31, sequence version 1, 3 pages, integrated into UniProt Mar. 15, 2005, retrieved on Jul. 6, 2015 <http://ibis.internal.epo.org/exam/dbfetch/jsp?id=UNITPRO:Q5EP31>.
Fouchier, R.A. et al., Public health and biosecurity. Restricted data on influenza H5N1 virus transmission, Science, 335(6069):662-3 (2012).
Herfst, S. et al., Airborne transmission of influenza A/H5N1 virus between ferrets, Science, 336(6088):1534-41 (2012).
Russell, C.A. et al., The potential for respiratory droplet-transmissible A/H5N1 influenza virus to evolve in a mammalian host, Science, 336(6088):1541-7 (2012).
Altschul, et al., Local Alignment Statistics, Methods in Enzymology, 266(27):460-480 (1996).
Ebner, C. et al., Identification of multiple N-cell epitopes on Bet v I, the Major Birch Pollen Allergen, using specific T cell clones and overlapping peptides, The Journal of Immunology, 150(3):1047-1054 (1993).
GenBank Accession No. ABC66574.1, GI:84797248, first referenced Feb. 13, 2006, updated Mar. 29, 2006 (1 page).
Yanbing, L, Research on the biological characteristics of subtype HPAIVs of H5N1 in year 2005-2007 in China, Chinese Doctoral Dissertations Full-Text Database, Volume: Agriculture Science, p. D050-25, Chapter 1, p. 3, English tanslation, (last accesed Apr. 20, 2014).
GenBank Accesssion No. ACT.15338, Influenza A virus (A/Egypt/N03450/2009(H5N1)), Jul. 7, 2009, 2 pages, retrieved Jan. 5, 2018.
GenBank, Accession No. JN807780.1 Influenza A virus (A/duck/Egypt/1085SS/2010(H5N1)) segment 4 hemagglutinin (HA) gene, complete cds, 3 pages, Oct. 24, 2011.

* cited by examiner

FIG. 1A

```
H1_Av   AVVSVGSSKYNRRFAPEIAARPEVRGQAGRMNYWLLDQGDTIFEATGNLIAPWYAFALNKGSD----------SGIITS-DAPVH-NCDTRCQTPHGALNSSLPFQNVHPIT
H1_Hu1  AVVSVGSSKYNRRFTPEIAARPKVRDQAGRMNYWLLEPGDTIFEATGNLIAPWYAFALNRGSG----------SGIITS-DAPVH-DCNTK

FIG. 1C

```
                          98                                136                                153
                                                             :                                 :
H1 SUBTYPE
ADA76    SYIIETSNSENGTC-PGEFIDYEELREQLSISSFEKFEIFPKASSWPNHETTKGV TAACSYSGASSFYRNL MT KKGTSY
ASI30    SYIVETSNSDNGTC-PGDFIDYEELREQLSSVSSFEKFEIFPKTSSWPNHETTRGV TAACPYAGASSFYRNL MI VKKGNSY
APR34    SYIVETPNSENGIC-PGDFIDYEELREQLSSVSSFEREFEIFPKESSWPNHNTNG-V TAACSHEGKSSFYRNL VT TEKEGSY
ASC18    SYIVETSNSENGIC-PGDFIDYEELREQLSSVSSFEKFEIFPKTSSWPNHETTKGV TAACSYAGASSFYRNL MI TKKGSSY
AT91     SYIAETPNPENGTC-PGYFADYEELREQLSSVSSFERFEIFPKESSWPNHTVTKGV TTSCCSHNGKSSFYRNL IM TKKNGLY
ANY18    SYIVETSNSENGTC-PGDFIDYEELREQLSSVSSFEKFEIFPKTSSWPNHETTKGV TAACSYAGASSFYRNL MT TKKGSSY

H3 SUBTYPE
ADU63    DLFVERSNAFS-NC PYDIPDYASLRSLVASSGTLEFITEG----FTWTGVTQNGG SSACKRGPANGFFSRLNW TKSESAY
AAI68    DLFVERSKAFS-NC PYDVPDYASLRSLVASSG----TLEFITEGFTWTG-VTQNGGSNACKRGPGSGFFSRLNW KSGSTY
AM99     DLFVERSKAYS-NC PYDVPDYASLRSLVASSGTLEFNNES----FNWMGVAQNGT SSCKRRSIKSFFSRLNW HQLKYRY

H5 SUBTYPE
ADS97    SYIVEKDNPVNGLC PENFNDYEELKHLLSSTNHFEKIRIIPR-SSWSNHDASSGV SACPYNGRSSFFRNVW IKKNNAY
Viet04   SYIVEKANPVNDLC PGDFNDYEELKHLSRINHFEKIQIIPK-SSWSSHEASLGV SSACPYQGKSSFFRNVW IKKNSTY
```

FIG. 2A

```
                                        183       190                            222 226
                                         :         :                              :   :
H1 SUBTYPE
ADA76    PKLSKSYTNNKGKEVLVLWGVHHPPSVSEQQSLYQNADAYVSVGSSKYNRRFAPEIAARPEVRGQAGRMNYYWTLLDQGDTI
ASI30    PKLSKSYVNNKGKEVLVLWGVHHPPSTDQSLYQNADAYVSVGSSKYNRRFTPEIAARPKVRSQAGRMNYYWTLLEPGDTI
APR34    PKLNSYVNNKGKEVLVLWGIHHPPNSKEQQNLYQNENAYVSVTSNYNRRFTPEIAERPKVRDQAGRMNYYWTLLKPGDTI
ASC18    PKLSKSYVNNKGKEVLVLWGVHHPPTGIDQQSLYQNADAYVSVGSSKYNRRFTPEIAARPKVRDQAGRMNYYWTLLEPGDTI
AT

```
POSITIONS FROM 1 TILL 60
CONSENSUS    MEKIVLLLAIVSLVKSDQICIGYHANNSTEQVDTIMEKNVTVTHAQDILEKTHNGKLCDL
AAL59142     ............................................................
AAZ29963     ...........F................................................
ABA70758     ...........F................................................
ABB87042     ..R.IA...I.I.G..................K........................E..
ABD14810     ............................................................
ABD46740     ------------................................................
ABD85144     -------F....................................................
ABE97569     .........................................................S.

POSITIONS FROM 61 TILL 120
CONSENSUS    DGVKPLILRDCSVAGWLLGNPMCDEFINVPEWSYIVEKANPANDLCYPGDFNDYEELKEL
AAL59142     ............................................................
AAZ29963     ............................................................
ABA70758     ............................................................
ABB87042     K..R...K.................................S.D..............
ABD14810     ....K....................................V.................
ABD46740     .........................................V.................
ABD85144     .......................L.................D.I.G...........I.
ABE97569     .......................L...........L.....I...............N.
ABD85144     .......................L...........L.....I...............N.
ABE97569     ...........................................................N.
```

FIG. 5B-1

```
POSITIONS FROM 121 TILL 180
CONSENSUS   LSRINHFEKIQIIPKSSWSDHEASSGVSSACPYQGKSSFFRNVVWLIKKNSAYPTIKRSY
AAL59142    ............................N...........H..................
AAZ29963    .................................S..L.................T...
ABA70758    .................................S..L.................T...
ABB87042    M.ST.........................................P.............
ABB87042    .........R...........N.D.........N.R..................N....T..
ABD14810    ....................................................I......I..
ABD46740    ..........................................R............DN.
ABD85144    ..........................................R............DN.
ABE97569    .............................................L.............

POSITIONS FROM 181 TILL 240
CONSENSUS   NNTNQEDLLVLWGIHHPNDAAEQTKLYQNPTTYISVGTSTLNQRLVPKIATRSKVNGQSG
AAL59142    ............................................................
AAZ29963    ............................................................
ABA70758    ............V...............................................
ABB87042    ........I...I...............................................
ABB87042    ................................SN..V........SI.E......P....
ABD14810    .........................................R..................R...
ABD46740    .........................................R..................R...
ABD85144    .........................................R..................R...
ABE97569    .........................................R..................R...
```

FIG. 5B-2

POSITIONS FROM 241 TILL 300
CONSENSUS   RMFFWTILKPNDAINFESNGNFIAPEYAYKIVKKGDSTIMKSELEYGNCNTKCQTPMGA
AAL59142    ............................................................
AAZ29963    .........................A..................................
ABA70758    ............................................................
ABB87042    ............................................................
ABD14810    ..............S................................A....D.....V.
ABD46740    .........V........................................D.........
ABD85144    ...........................................................I
ABD85144    .............................N...................I..........
ABE97569    .............................N...................I..........
            .........S.................A.................................

POSITIONS FROM 301 TILL 360
CONSENSUS   INSSMPFHNIHPLTIGECPKYVKSNRLVLATGLRNSPQRERRRKKRGLFGAIAGFIEGGW
AAL59142    ............................................................
AAZ29963    ..........................................T...G.............
ABA70758    ............................................................
ABB87042    ...........V...........DK...................K................
ABD14810    ....................................V.........---T..........
ABD46740    ..............................................-.............
ABD85144    ................................................G...........
ABD85144    ................................................G...........
ABE97569    ..............................................................

FIG. 5B-3

```
POSITIONS FROM 361 TILL 420
CONSENSUS  QGMVDGWYGYHHSNEQGSGYAADKESTQKAIDGVTNKVNSIIDKMNTQFEAVGREFNNLE
AAL59142   ............................................................
AAZ29963   ............................................................
ABA70758   ...................K........................................
ABB87042   ............................................................
ABD14810   ..................................I.........................
ABD46740   ............................................................
ABD85144   .......................................................T.K..
ABE97569   ...........................................K................

POSITIONS FROM 421 TILL 480
CONSENSUS  RRIENLNKKMEDGFLDVWTYNAELLVLMENERTLDFHDSNVKNLYDKVRLQLRDNAKELG
AAL59142   ............................................................
AAZ29963   ............................................................
ABA70758   ............................................................
ABB87042   ............................................................
ABD14810   ............................................................
ABD46740   ............................................................
ABD85144   ............................................................
ABE97569   ............................................................
```

```
POSITIONS FROM 481 TILL 540
CONSENSUS   NGCFEFYHKCDNECMESVRNGTYDYPQYSEEARLKREEISGVKLESIGTYQILSIYSTVA
AAL59142    ............................................................
AAZ29963    ..................K.........................M..............
ABA70758    ...........................................................I
ABB87042    ...........................................................I
ABD14810    ...........................S..N...D........M................
ABD46740    ..........R..................................................
ABD85144    ..........R...................................................
ABE97569    .............I....N..........................................I

POSITIONS FROM 541 TILL 568
CONSENSUS   SSLALAIMVAGLSLMMCSNGSLQCRICI
AAL59142    ............................
AAZ29963    -----------------------------
ABA70758    ............................
ABB87042    ........F...................
ABD14810    ............................
ABD46740    ..............-------------
ABD85144    ........F..............VTM---
ABE97569    ....M.......................
```

FIG. 5B-5

*AAL59142:* 568 Avian 4 (HA) H5N1 Hong Kong 2000 Influenza A virus (A/Goose/Hong Kong/385.3.2000(H5N1))

*AAZ29963:* 556 Avian 4 (HA) H5N1 Thailand 2004 Influenza A virus (A/Ostrich/Samut Prakan/Thailand/CU-19/04(H5N1))

*ABA70758:* 568 Avian 4 (HA) H5N1 Belgium 2004 Influenza A virus (A/crested eagle/Belgium/01/2004(H5N1))

*ABB87042:* 564 Avian 4 (HA) H5N2 Canada 1976/08/12 Influenza A virus (A/mallard duck/ALB/57/1976(H5N2))

*ABD14810:* 567 Avian 4 (HA) H5N1 China 2004 Influenza A virus (A/duck/Guangxi/13/2004(H5N1))

*ABD46740:* 556 Avian 4 (HA) H5N1 Nigeria 2006/01/17 Influenza A virus (A/chicken/Nigeria/641/2006(H5N1))

*ABD85144:* 557 Avian 4 (HA) H5N1 Egypt 2006 Influenza A virus (A/chicken/Egypt/960N3-004/2006(H5N1))

*ABE97569:* 553 Avian 4 (HA) H5N1 Indonesia 2004 Influenza A virus (A/turkey/Kedaton/BPPV3/2004(H5N1))

FIG. 5B-6

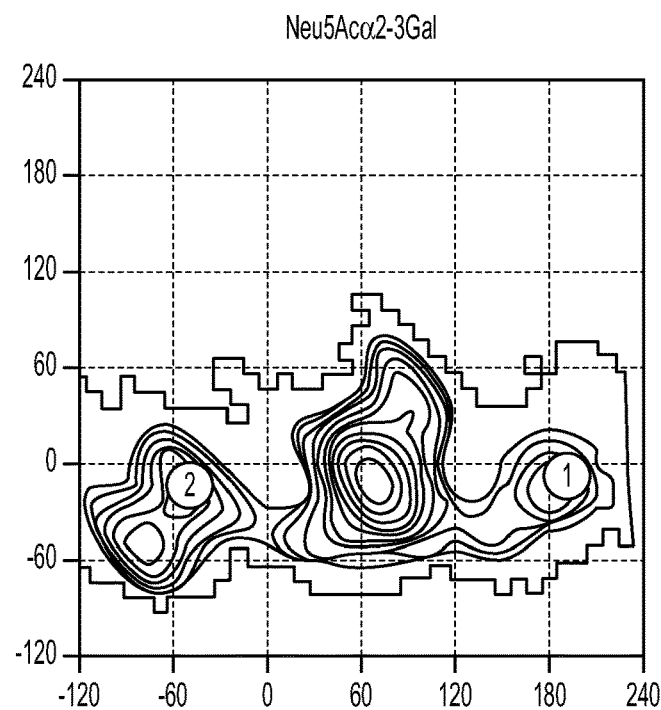
FIG. 6C-A
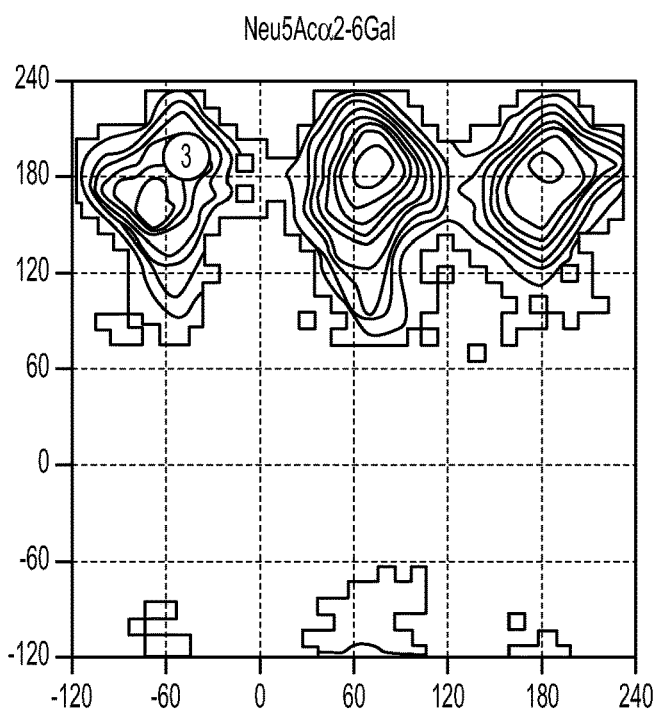
FIG. 6C-B

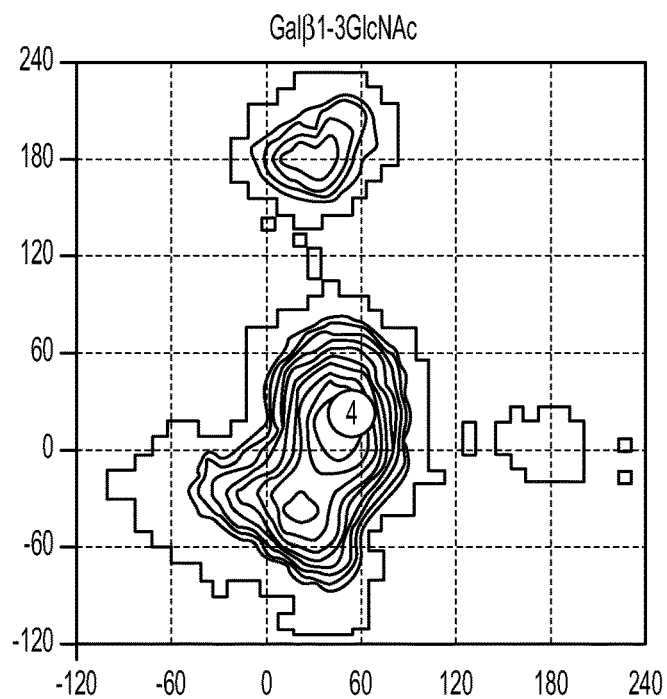
FIG. 6C-C
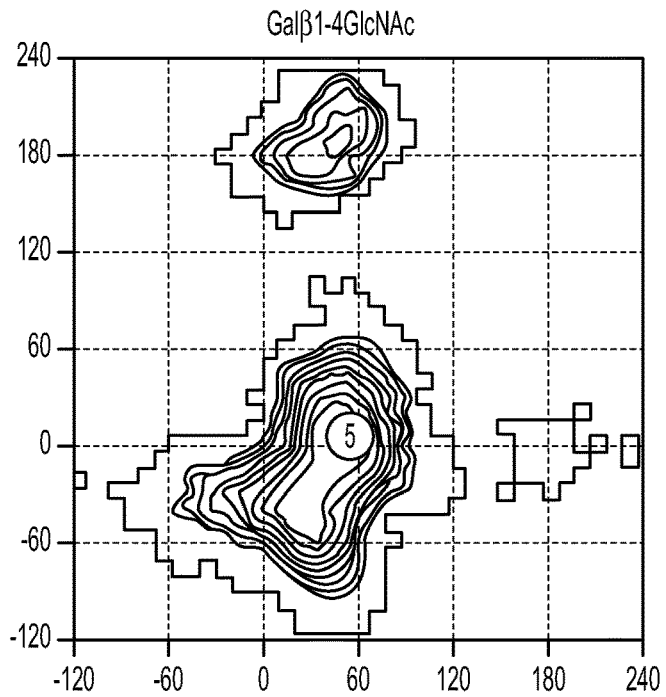
FIG. 6C-D

CONFORMATIONAL SAMPLING OF α2-3 LINKAGE

| CONE-LIKE | 100% |
|---|---|
| UMBRELLA-LIKE | 0% |

FIG. 6C-E

CONFORMATIONAL SAMPLING OF α2-6 LINKAGE

| | UMBRELLA-LIKE (%) : CONE-LIKE (%) |
|---|---|
| $\omega = -60°$ | 60 : 20 |
| $\omega = +60°$ | 10 : 40 |
| $\omega = 180°$ | 30 : 30 |

FIG. 6C-F

α2-3 AND α2-6 MOTIF IN CONE TOPOLOGY

• TYPICAL OF SHORT OLIGOSACCHARIDE OR OLIGOSACCHARIDE BRANCH ATTACHED TO A CORE STRUCTURE

• SHORT BRANCH OF N-LINKED CORE

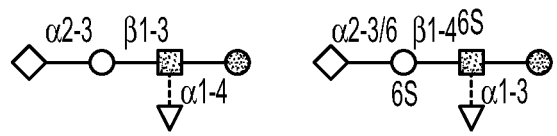

• SHORT BRANCH OF O-LINKED CORE

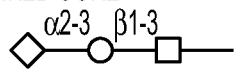

• THE CONE TOPOLOGY CAN ALSO BE ADOPTED BY LONGER α2-3 AND α2-6 OLIGOSACCHARIDE BRANCH ATTACHED TO CORE STRUCTURE

◇ Neu5Ac   ○ Gal    ● Man    □ GalNAc
▽ Fuc      ◎ Glc             ▩ GlcNAc

DOTTED GRAY LINES, 4S AND 6S INDICATE POTENTIAL SITES FOR FUCOSYLATION AND SULFATION MODIFICATIONS

FIG. 8

LONG α2-6 *UMBRELLA-LIKE* TOPOLOGY GLYCAN DECOYS
O-LINKED GLYCANS:
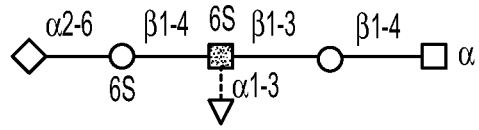
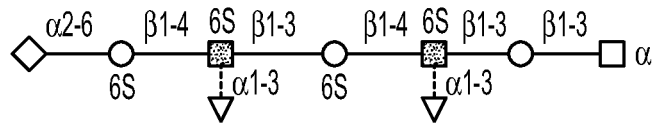
*α2-6 TYPE 2 EXTENSION BRANCH IN A CORE 1 TYPE STRUCTURE*
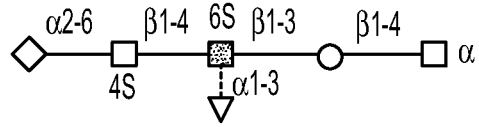
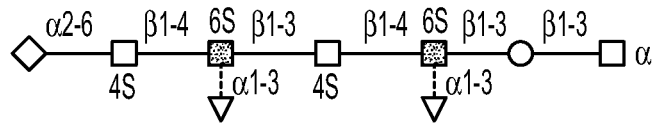
*α2-6 LacDiNAc EXTENSION BRANCH IN A CORE 1 TYPE STRUCTURE*
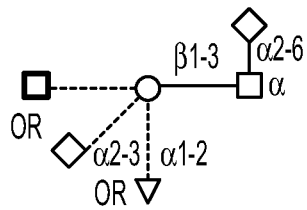
*α2-6 ATTACHED TO CORE GalNAc IN CORE 1 TYPE STRUCTURE*
FIG. 9A-3

LONG α2-6 *UMBRELLA*-LIKE TOPOLOGY GLYCAN DECOYS
O-LINKED GLYCANS:
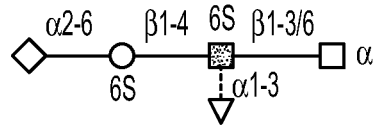
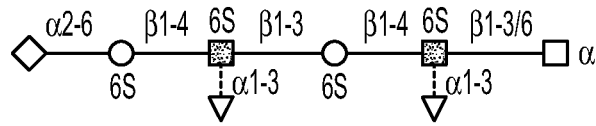
*α2-6 TYPE 2 EXTENSION BRANCH IN A CORE 2 OR 3 OR 4 TYPE STRUCTURE*
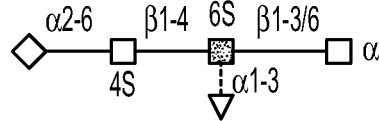
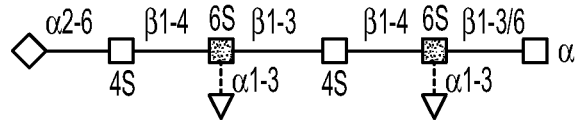
*α2-6 LacDiNAc EXTENSION BRANCH IN A CORE 2 OR 3 OR 4 TYPE STRUCTURE*
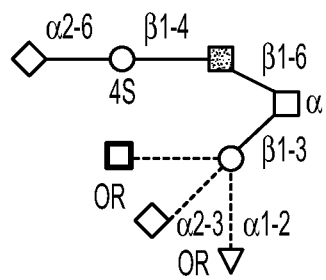 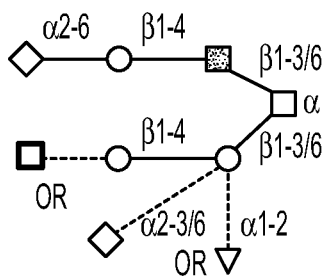
*α2-6 ATTACHED TO BRANCHED CORE 2 AND CORE 4 STRUCTURES*
FIG. 9A-4

LONG α2-6 UMBRELLA-LIKE TOPOLOGY GLYCAN DECOYS
GLYCOLIPIDS:
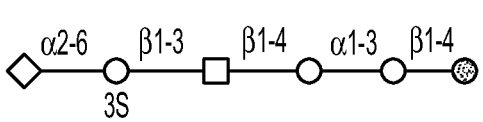
GLUCOSYLCERAMIDE CORE ISOGLOBO TYPE
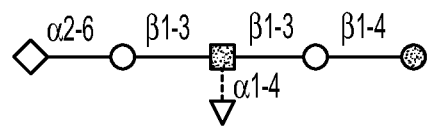
GLUCOSYLCERAMIDE CORE LACTO TYPE
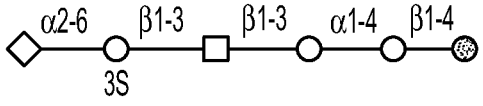
GLUCOSYLCERAMIDE CORE GLOBO TYPE
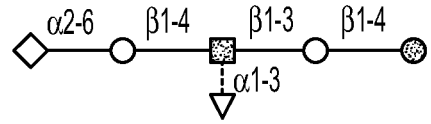
GLUCOSYLCERAMIDE CORE NEOLACTO TYPE
FIG. 9A-6

LONG α2-6 *UMBRELLA*-LIKE TOPOLOGY GLYCAN THAT ARE NOT DECOYS

GLYCOLIPIDS:

*GLUCOSYLCERAMIDE CORE GANGLIO TYPE*

*GLUCOSYLCERAMIDE CORE GLOBO TYPE*

LECTIN STAINING OF UPPER RESPIRATORY TISSUE SECTIONS

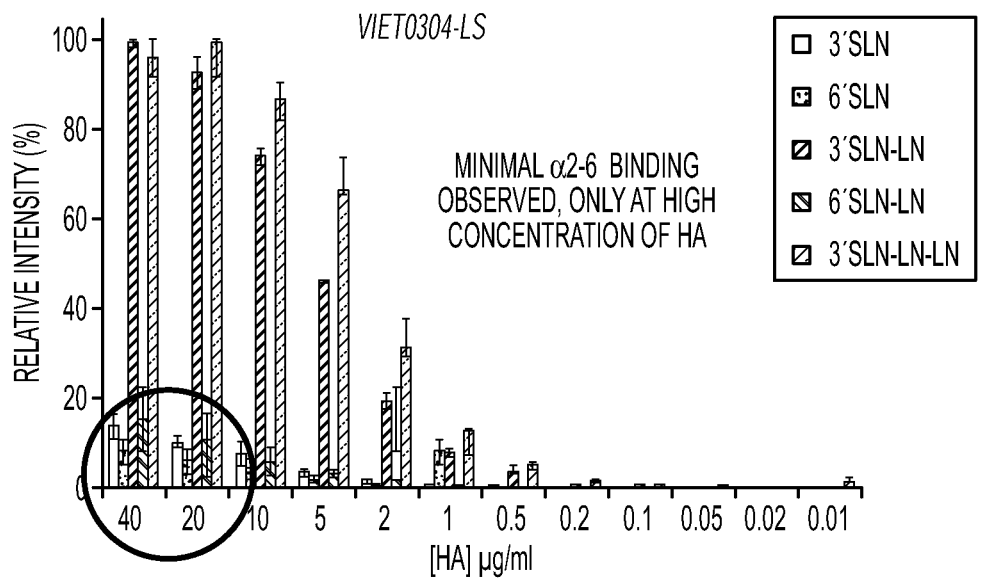
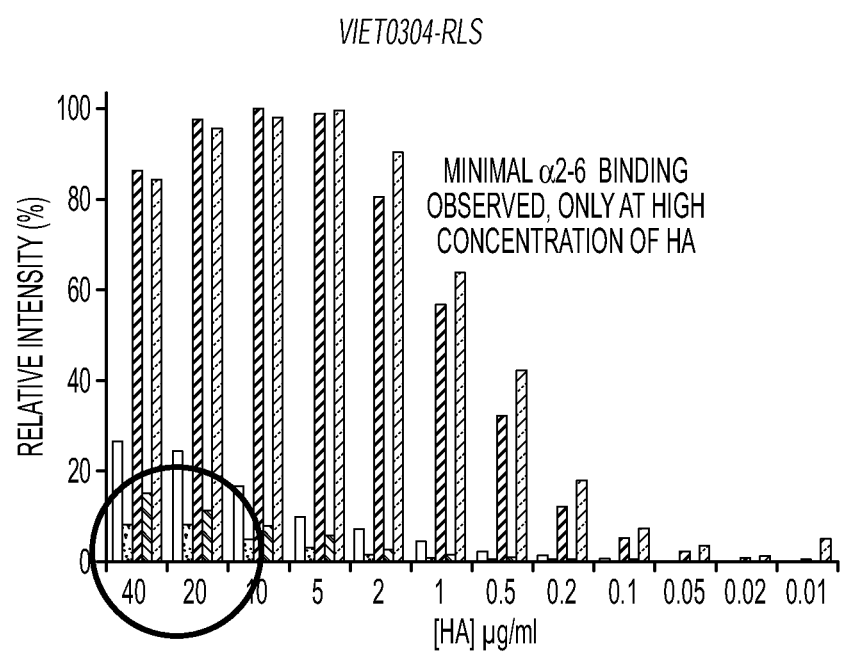
FIG. 15

FIG. 18

```
                                        DELETION              158 GLYCOSYLATION
Alb_6_58         LSSVKHFEKVKILPKDRWIQHTTT-GGSRACAVSGNPSFFRNMVWLTKKGSNYPVAKGSY
ckEgy_07         LSRINHFEKIQIIPKNSWSDHEAS-GVSSACPYQGRSSFFRNVVWLTKKDNAYPTIKRSY
ckEgy_07_LS      LSRINHFEKIQIIPKNSWSDHEAS-GVSSACPYQGRSSFFRNVVWLTKKDNAYPTIKRSY
Egy_2786-N3_06   LSRINHFEKIQIIPKSSWSDHEASSGVSSACPYQGRSSFFRNVVWLIKKDNAYPTIKRSY
Ind_5_05         LSRINHFEKIQIIPKSSWSDHEASSGVSSACPYLGSPSFFRNVVWLIKKNSTYPTIKKSY
Viet_1203_04     LSRINHFEKIQIIPKSSWSSHEASLGVSSACPYQGKSSFFRNVVWLIKKNSTYPTIKRSY
HK_213_03        LSRINHFEKIQIIPKNSWSSHEASLGVSSACPYQGKSSFFRNVVWLIKKNNAYPTIKRSY
HK_486_97        LSRINHFEKIQIIPKSSWSNHDASSGVSSACPYLGRSSFFRNVVWLKKNSAYPTIKRSY
                                         130-LOOP SWITCH IN CHARGE              LS MUTATION
Alb_6_58         NNTSGEQMLIIWGVHHPNDETEQRTLYQNVGTYVSVGTSTLNKRSTPDIATRPKVNGLGS
ckEgy_07         NNTNQEDLLVLWGIHHPNDAAEQTRLYQNPTTQISVGTSTLNQRLVPKIATRSKVNGQSG
ckEgy_07_LS      NNTNQEDLLVLWGIHHPNDAAEQTRLYQNPTTQISVGTSTLNQRLVPKIATRSKVNGLSS
Egy_2786-N3_06   NNTNQEDLLVLWGIHHPNDAAEQTRLYQNPTTYISVGTSTLNQRLVPKIATRSKVNGQSG
Ind_5_05         NNTNQEDLLVLWGIHHPNDAAEQTMLYQNPTTYISIGTSTLNQRLVPKIATRSKVNGQSG
Viet_1203_04     NNTNQEDLLVLWGIHHPNDAAEQTKLYQNPTTYISVGTSTLNQRLVPRIATRSKVNGQSG
HK_213_03        NNTNQEDLLVLWGIHHPNDAAEQTRLYQNPTTYISVGTSTLNQRLVPKIATRSKVNGQNG
HK_486_97        NNTNQEDLLVLWGIHHPNDAAEQTKLYQNPTTYISVGTSTLNQRLVPEIATRPKVNGQSG
                                  190-HELIX                    220-LOOP
```

FIG. 23

A/CHICKEN/EGYPT/R2/2007 (ckEgy_07) H5N1 HA

FIG. 24A

A/CHICKEN/EGYPT/R2/2007 LS MUTANT (ckEgy_07_LS) H5N1 HA

FIG. 24B ckEgy_07_LS MUTANT HA/PI

FIG. 24C

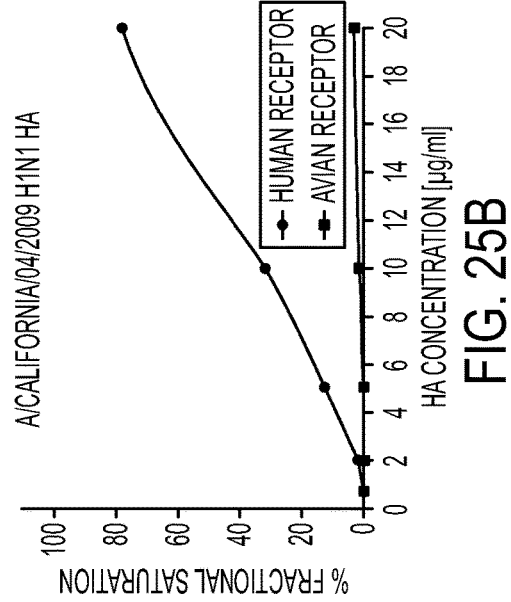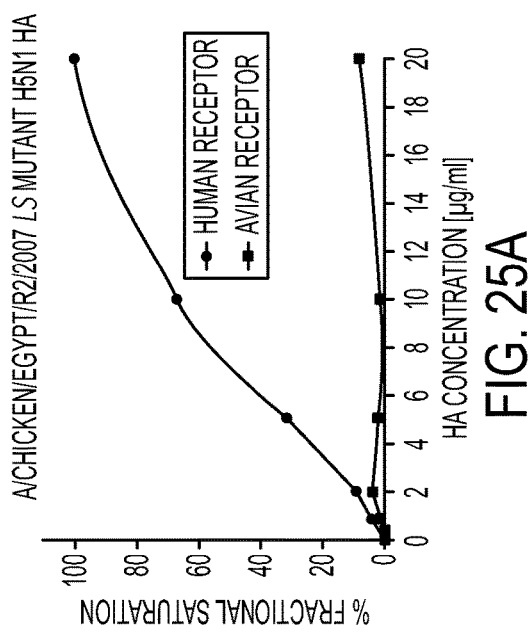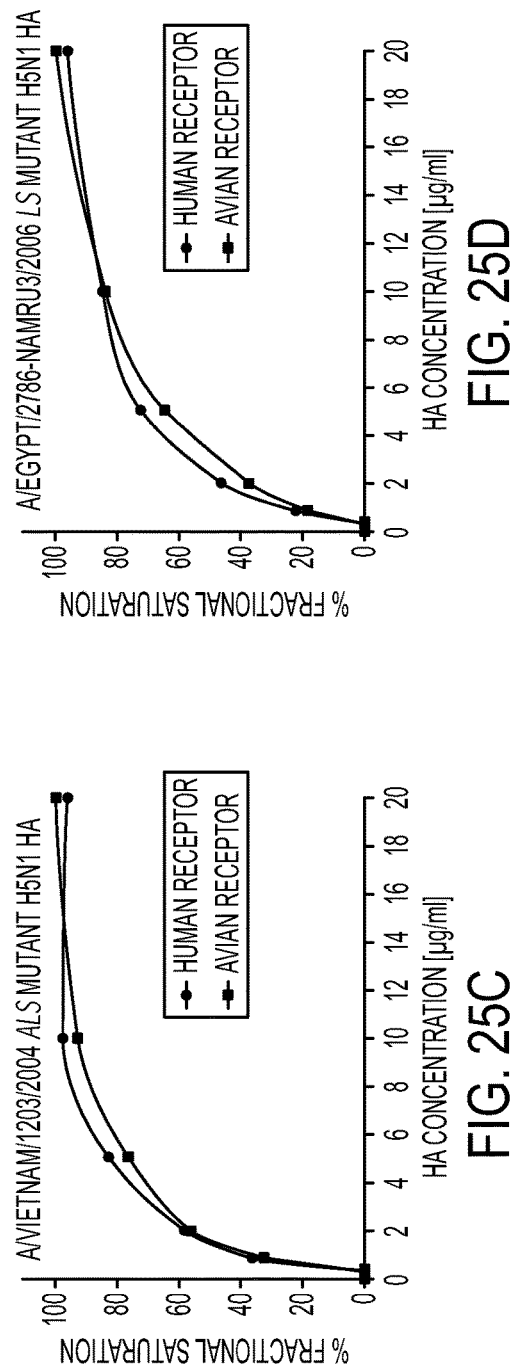
FIG. 25A
FIG. 25B
FIG. 25C
FIG. 25D

FIG. 26

EXPANDED NOMENCLATURE OF GLYCANS USED IN THE GLYCAN ARRAY

| GLYCAN | EXPANDED NOMENCLATURE |
|---|---|
| 3'SLN | Neu5Acα2-3Galβ1-4GlcNAcβ1- |
| 6'SLN | Neu5Acα2-6Galβ1-4GlcNAcβ1- |
| 3'SLN-LN | Neu5Acα2-3Galβ1-4GlcNAcβ1-3Galβ1-4GlcNAcβ1- |
| 6'SLN-LN | Neu5Acα2-6Galβ1-4GlcNAcβ1-3Galβ1-4GlcNAcβ1- |
| 3'SLN-LN-LN | Neu5Acα2-3Galβ1-4GlcNAcβ1-3Galβ1-4GlcNAcβ1-3Galβ1-4GlcNAcβ1 |

KEY: Neu5Ac: N-ACETYL D-NEURAMINIC ACID; Gal: D-GALACTOSE; GlcNAc: N-ACETYL D-GLUCOSAMINE. α / β: ANOMERIC CONFIGURATION OF THE PYRANOSE SUGARS. ALL THE SUGARS ARE LINKED VIA A SPACER TO BIOTIN (-Sp-LC-LC-BIOTIN AS DESCRIBED IN http://www.functionalglycomics.org/static/consortium/resources/resourcecored5.shtml)

FIG. 28

HEMAGGLUTININ POLYPEPTIDES, AND REAGENTS AND METHODS RELATING THERETO

CROSS-REFERENCE TO RELATED APPLICATIONS

The present application claims the benefit of U.S. Provisional Application No. 61/389,639 filed Oct. 4, 2010, the complete contents of which is incorporated herein by reference.

GOVERNMENT SUPPORT

This invention was made with government support under grant numbers GM57073 and U54 GM62116 awarded by National Institutes of Health. The United States government has certain rights in this invention.

BACKGROUND

Influenza has a long history of pandemics, epidemics, resurgences and outbreaks. Avian influenza, including the H5N1 strain, is a highly contagious and potentially fatal pathogen, but it currently has only a limited ability to infect humans. However, avian flu viruses have historically observed to accumulate mutations that alter its host specificity and allow it to readily infect humans. In fact, two of the major flu pandemics of the last century originated from avian flu viruses that changed their genetic makeup to allow for human infection.

There is a significant concern that the current H5N1, H7N7, H9N2 and H2N2 avian influenza strains might accumulate mutations that alter their host specificity and allow them to readily infect humans. Therefore, there is a need to assess whether the HA protein in these strains can, in fact, convert to a form that can readily infect humans, and a further need to identify HA variants with such ability. There is a further need to understand the characteristics of HA proteins generally that allow or prohibit infection of different subjects, particularly humans. There is also a need for vaccines and therapeutic strategies for effective treatment or delay of onset of disease caused by influenza virus.

SUMMARY

The present invention binding agents with particular glycan binding characteristics. In particular, the present invention provides binding agents that bind to sialylated glycans having an umbrella-like topology. In some embodiments, binding agents in accordance with the invention bind to umbrella-topology glycans with high affinity and/or specificity. In some embodiments, binding agents in accordance with the invention show a binding preference for umbrella-topology glycans as compared with cone-topology glycans. In some embodiments, binding agents in accordance with the invention compete with hemagglutinin for binding to glycans on hemagglutinin receptors. In some embodiments, binding agents in accordance with the invention compete with hemagglutinin for binding to umbrella-topology glycans.

The present invention also provides diagnostic and therapeutic reagents and methods associated with provided binding agents, including vaccines.

The present invention particularly encompasses the recognition that HA polypeptide variants (e.g., H1, H2, H3, H4, H5, H6, H7, H8, H9, H10, H11, H12, H13, H14, H15, or H16 HA polypeptide variants) with altered glycosylation can show increased (or decreased) binding to human HA receptors as compared with a reference HA polypeptide. In some embodiments, the reference polypeptide is an HA polypeptide of any of the following:

A/South Carolina/1/18 (H1):

(SEQ ID NO: 43)

MEARLLVLLCAFAATNADTICIGYHANNSTDTVDTVLEKNVTVTHSVNLLEDSHNGKLCKLKGI

APLQLGKCNIAGWLLGNPECDLLLTASSWSYIVETSNSENGTCYPGDFIDYEELREQLSSVSSF

EKFEIFPKTSSWPNHETTKGVTAACSYAGASSFYRNLLWLTKKGSSYPKLSKSYVNNKGKEVLV

LWGVHHPPTGTDQQSLYQNADAYVSVGSSKYNRRFTPEIAARPKVRDQAGRMNYYWTLLEPGDT

ITFEATGNLIAPWYAFALNRGSGSGIITSDAPVHDCNTKCQTPHGAINSSLPFQNIHPVTIGEC

PKYVRSTKLRMATGLRNIPSIQSRGLFGAIAGFIEGGWTGMIDGWYGYHHQNEQGSGYAADQKS

TQNAIDGITNKVNSVIEKMNTQFTAVGKEFNNLERRIENLNKKVDDGFLDIWTYNAELLVLLEN

ERTLDFHDSNVRNLYEKVKSQLKNNAKEIGNGCFEFYHKCDDACMESVRNGTYDYPKYSEESKL

NREEIDGVKLESMGVYQILAIYSTVASSLVLLVSLGAISFWMCSNGSLQCRICI

A/Brisbane/59/07 (H1):

(SEQ ID NO: 44)

MKVKLLVLLCTFTATYADTICIGYHANNSTDTVDTVLEKNVTVTHSVNLLENSHNGKLCLLKGI

APLQLGNCSVAGWILGNPECELLISKESWSYIVEKPNPENGTCYPGHFADYEELREQLSSVSSF

ERFEIFPKESSWPNHTVTGVSASCSHNGESSFYRNLLWLTGKNGLYPNLSKSYANNKEKEVLVL

WGVHHPPNIGDQKALYHTENAYVSVVSSHYSRKFTPEIAKRPKVRDQEGRINYYWTLLEPGDTI

IFEANGNLIAPRYAFALSRGFGSGIINSNAPMDKCDAKCQTPQGAINSSLPFQNVHPVTIGECP

KYVRSAKLRMVTGLRNIPSIQSRGLFGAIAGFIEGGWTGMVDGWYGYHHQNEQGSGYAADQKST

QNAINGITNKVNSVIEKMNTQFTAVGKEFNKLERRMENLNKKVDDGFIDIWTYNAELLVLLENE

-continued

RTLDFHDSNVKNLYEKVKSQLKNNAKEIGNGCFEFYHKCNDECMESVKNGTYDYPKYSEESKLN

REKIDGVKLESMGVYQILAIYSTVASSLVLLVSLGAISFWMCSNGSLQCRICI

A/California/04/09 (H1):
(SEQ ID NO: 45)
MKAILVVLLYTFATANADTLCIGYHANNSTDTVDTVLEKNVTVTHSVNLLEDKHNGKLCK

LRGVAPLHLGKCNIAGWILGNPECESLSTASSWSYIVETPSSDNGTCYPGDFIDYEELRE

QLSSVSSFERFEIFPKTSSWPNHDSNKGVTAACPHAGAKSFYKNLIWLVKKGNSYPKLSK

SYINDKGKEVLVLWGIHHPSTSADQQSLYQNADTYVFVGSSRYSKKFKPEIAIRPKVRDQ

EGRMNYYWTLVEPGDKITFEATGNLVVPRYAFAMERNAGSGIIISDTPVHDCNTTCQTPK

GAINTSLPFQNIHPITIGKCPKYVKSTKLRLATGLRNIPSIQSRGLFGAIAGFIEGGWTG

MVDGWYGYHHQNEQGSGYAADLKSTQNAIDEITNKVNSVIEKMNTQFTAVGKEFNHLEKR

IENLNKKVDDGFLDIWTYNAELLVLLENERTLDYHDSNVKNLYEKVRSQLKNNAKEIGNG

CFEFYHKCDNTCMESVKNGTYDYPKYSEEAKLNREEIDGVKLESTRIYQILAIYSTVASS

LVLVVSLGAISFWMCSNGSLQCRICI

A/Albany/6/58 (H2):
(SEQ ID NO: 46)
MAIIYLILLFTAVRGDQICIGYHANNSTEKVDTILERNVTVTHAKDILEKTHNGKLCKLNGIPP

LELGDCSIAGWLLGNPECDRLLSVPEWSYIMEKENPRDGLCYPGSFNDYEELKHLLSSVKHFEK

VKILPKDRWTQHTTTGGSRACAVSGNPSFFRNMVWLTKKGSNYPVAKGSYNNTSGEQMLIIWGV

HHPNDETEQRTLYQNVGTYVSVGTSTLNKRSTPDIATRPKVNGLGSRMEFSWTLLDMWDTINFE

STGNLIAPEYGFKISKRGSSGIMKTEGTLGNCETKCQTPLGAINTTLPFHNVHPLTIGECPKYV

KSEKLVLATGLRNVPQIESRGLFGAIAGFIEGGWQGMVDGWYGYHHSNDQGSGYAADKESTQKA

FDGITNRVNSVIEKMNTQFEAVGKEFSNLERRLENLNKKMEDGFLDVWTYNAELLVLMENERTL

DFHDSNVKNLYDKVKMQLRDNVKELGNGCFEFYPKCDDECMNSVKNGTYDYPKYEEESKLNRNE

IKGVKLSSMGVYQILAIYATVAGSLSLAIMMAGISFWMCSNGSLQCRICI

A/Aichi/1/68 (H3):
(SEQ ID NO: 47)
MKTIIALSYIFCLALGQDLPGNDNSTATLCLGHHAVPNGTLVKTITDDQIEVTNATELVQSSST

GKICNNPHRILDGIDCTLIDALLGDPHCDVFQNETWDLFVERSKAFSNCYPYDVPDYASLRSLV

ASSGTLEFITEGFTWTGVTQNGGSNACKRGPGSGFFSRLNWLTKSGSTYPVLNVTMPNNDNFDK

LYIWGIHHPSTNQEQTSLYVQASGRVTVSTRRSQQTIIPNIGSRPWVRGLSSRISIYWTIVKPG

DVLVINSNGNLIAPRGYFKMRTGKSSIMRSDAPIDTCISECITPNGSIPNDKPFQNVNKITYGA

CPKYVKQNTLKLATGMRNVPEKQTRGLFGAIAGFIENGWEGMIDGWYGFRHQNSEGTGQAADLK

STQAAIDQINGKLNRVIEKTNEKFHQIEKEFSEVEGRIQDLEKYVEDTKIDLWSYNAELLVALE

NQHTIDLTDSEMNKLFEKTRRQLRENAEEMGNGCFKIYHKCDNACIESIRNGTYDHDVYRDEAL

NNRFQIKGVELKSGYKDWILWISFAISCFLLCVVLLGFIMWACQRGNIRCNICI

A/Moscow/10/99 (H3):
(SEQ ID NO: 48)
MKTIIALSYILCLVFAQKLPGNDNSTATLCLGHHAVPNGTLVKTITNDQIEVTNATELV

QSSSTGRICDSPHQILDGENCTLIDALLGDPHCDGFQNKEWDLFVERSKAYSNCYPYDV

PDYASLRSLVASSGTLEFNNESFNWTGVAQNGTSSSCKRRSIKSFFSRLNWLHQLKYRY

PALNVTMPNNDKFDKLYIWGVHHPSTDSDQTSLYTQASGRVTVSTKRSQQTVIPNIGSR

PWVRGISSRISIYWTIVKPGDILLINSTGNLIAPRGYFKIRSGKSSIMRSDAPIGKCNS

ECITPNGSIPNDKPFQNVNRITYGACPRYVKQNTLKLATGMRNVPEKQTRGIFGAIAGF

-continued

IENGWEGMMDGWYGFRHQNSEGTGQAADLKSTQAAINQINGKLNRLIEKTNEKFHQIEK

EFSEVEGRIQDLEKYVEDTKIDLWSYNAELLVALENQHTIDLTDSEMNKLFERTRKQLR

ENAEDMGNGCFKIYHKCDNACIGSIRNGTYDHDVYRDEALNNRFQIKGVELKSGYKDWI

LWISFAISCFLLCVVLLGFIMWACQKGNIRCNICI

A/Perth/16/09 (H3):
(SEQ ID NO: 49)
MKTIIALSYILCLVFAQKLPGNDNSTATLCLGHHAVPNGTIVKTITNDQIEVTNATELVQSSST

GEICDSPHQILDGKNCTLIDALLGDPQCDGFQNKKWDLFVERSKAYSNCYPYDVPDYASLRSLV

ASSGTLEFNNESFNWTGVTQNGTSSACIRRSKNSFFSRLNWLTHLNFKYPALNVTMPNNEQFDK

LYIWGVHHPGTDKDQIFLYAQASGRITVSTKRSQQTVSPNIGSRPRVRNIPSRISIYWTIVKPG

DILLINSTGNLIAPRGYFKIRSGKSSIMRSDAPIGKCNSECITPNGSIPNDKPFQNVNRITYGA

CPRYVKQNTLKLATGMRNVPEKQTRGIFGAIAGFIENGWEGMVDGWYGFRHQNSEGRGQAADLK

STQAAIDQINGKLNRLIGKTNEKFHQIEKEFSEVEGRIQDLEKYVEDTKIDLWSYNAELLVALE

NQHTIDLTDSEMNKLFEKTKKQLRENAEDMGNGCFKIYHKCDNACIGSIRNGTYDHDVYRDEAL

NNRFQIKGVELKSGYKDWILWISFAISCFLLCVALLGFIMWACQKGNIRCNICI

A/Vietnam/1203/04 (H5):
(SEQ ID NO: 50)
MEKIVLLFAIVSLVKSDQICIGYHANNSTEQVDTIMEKNVTVTHAQDILEKKHNGKLCDLDGVK

PLILRDCSVAGWLLGNPMCDEFINVPEWSYIVEKANPVNDLCYPGDFNDYEELKHLLSRINHFE

KIQIIPKSSWSSHEASLGVSSACPYQGKSSFFRNVVWLIKKNSTYPTIKRSYNNTNQEDLLVLW

GIHHPNDAAEQTKLYQNPTTYISVGTSTLNQRLVPRIATRSKVNGQSGRMEFFWTILKPNDAIN

FESNGNFIAPEYAYKIVKKGDSTIMKSELEYGNCNTKCQTPMGAINSSMPFHNIHPLTIGECPK

YVKSNRLVLATGLRNSPQRERRRKKRGLFGAIAGFIEGGWQGMVDGWYGYHHSNEQGSGYAADK

ESTQKAIDGVTNKVNSIIDKMNTQFEAVGREFNNLERRIENLNKKMEDGFLDVWTYNAELLVLM

ENERTLDFHDSNVKNLYDKVRLQLRDNAKELGNGCFEFYHKCDNECMESVRNGTYDYPQYSEEA

RLKREEISGVKLESIGIYQILSIYSTVASSLALAIMVAGLSLWMCSNGSLQCRICI

A/Egypt/2786-NAMRU3/06 (H5):
(SEQ ID NO: 51)
MEKIVLLLAIVSLVKSDQICIGYHANNSTEQVDTIMEKNVTVTHAQDILEKTHNGKLCDLDGVK

PLILRDCSVAGWLLGNPMCDEFLNVPEWSYIVEKINPANDLCYPGNFNDYEELKHLLSRINHFE

KIQIIPKSSWSDHEASSGVSSACPYQGRSSFFRNVVWLIKKDNAYPTIKRSYNNTNQEDLLVLW

GIHHPNDAAEQTRLYQNPTTYISVGTSTLNQRLVPKIATRSKVNGQSGRMEFFWTILKSNDAIN

FESNGNFIAPENAYKIVKKGDSTIMKSELEYGNCNTKCQTPIGAINSSMPFHNIHPLTIGECPK

YVKSNRLVLATGLRNSPQGERRRKKRGLFGAIAGFIEGGWQGMVDGWYGYHHSNEQGSGYAADK

ESTQKAIDGVTNKVNSIIDKMNTQFEAVGREFNNLERRIENLNKKMEDGFLDVWTYNAELLVLM

ENERTLDFHDSNVKNLYDKVRLQLRDNAKELGNGCFEFYHRCDNECMESVRNGTYDYPQYSEEA

RLKREEISGVKLESIGTYQILSIYSTVASSLALAIMVAGLFLWMCSNGSLQCRICI

A/New York/107/03 (H7):
(SEQ ID NO: 52)
MNTQILAFIACVLTGVKGDKICLGHHAVANGTKVNTLTERGIEVVNATETVETTNIKKICTQGK

RPTDLGQCGLLGTLIGPPQCDQFLEFSSDLIIERREGTDICYPGRFTNEESLRQILRRSGGIGK

ESMGFTYSGIRTNGATSACTRSGSSFYAEMKWLLSNSDNAAFPQMTKAYRNPRNKPALIIWGVH

HSESVSEQTKLYGSGNKLITVRSSKYQQSFTPNPGARRIDFHWLLLDPNDTVTFTFNGAFIAPD

RTSFFRGESLGVQSDAPLDSSCRGDCFHSGGTIVSSLPFQNINSRTVGKCPRYVKQKSLLLATG

MRNVPEKPKPRGLFGAIAGFIENGWEGLINGWYGFRHQNAQGEGTAADYKSTQSAIDQITGKLN

-continued

RLIGKTNQQFELIDNEFNEIEQQIGNVINWTRDAMTEIWSYNAELLVAMENQHTIDLADSEMSK

LYERVKKQLRENAEEDGTGCFEIFHKCDDQCMESIRNNTYDHTQYRTESLQNRIQIDPVKLSSG

YKDIILWFSFGASCFLLLAIAMGLVFICIKNGNMQCTICI

The present invention also particularly encompasses the recognition that HA polypeptide variants (e.g., H1, H2, H3, H4, H5, H6, H7, H8, H9, H10, H11, H12, H13, H14, H15, or H16 HA polypeptide variants) with alterations in the HA loop region, can show increased (or decreased) binding to human HA receptors as compared with a reference HA polypeptide (including, for example, an HA polypeptide of any of SEQ ID NOs: 43-52).

In some embodiments, the present invention encompasses the recognition that H5 HA polypeptide variants with altered glycosylation can show increased (or decreased) binding to human HA receptors as compared with a reference HA polypeptide. In some embodiments, the reference polypeptide is an HA polypeptide of any of the following:

A/Hongkong/486/97
(SEQ ID NO: 53)
MEKIVLLLATVSLVKSDQICIGYHANNSTEQVDTIMEKNVTVTHAQDILERTHNGKLCDLNGVK

PLILRDCSVAGWLLGNPMCDEFINVPEWSYIVEKASPANDLCYPGNFNDYEELKHLLSRINHFE

KIQIIPKSSWSNHDASSGVSSACPYLGRSSFFRNVVWLIKKNSAYPTIKRSYNNTNQEDLLVLW

GIHHPNDAAEQTKLYQNPTTYISVGTSTLNQRLVPEIATRPKVNGQSGRMEFFWTILKPNDAIN

FESNGNFIAPEYAYKIVKKGDSTIMKSELEYGNCNTKCQTPMGAINSSMPFHNIHPLTIGECPK

YVKSNRLVLATGLRNTPQRERRRKKRGLFGAIAGFIEGGWQGMVDGWYGYHHSNEQGSGYAADK

ESTQKAIDGVTNKVNSIINKMNTQFEAVGREFNNLERRIENLNKKMEDGFLDVWTYNAELLVLM

ENERTLDFHDSNVKNLYDKVRLQLRDNAKELGNGCFEFYHKCDNECMESVKNGTYDYPQYSEEA

RLNREEISGVKLESMGTYQILSIYSTVASSLALAIMVAGLSLWMCSNGSLQCRICI

A/Hongkong/213/03
(SEQ ID NO: 54)
MEKIVLLFAIVSLVKSDQICIGYHANNSTEQVDTIMEKNVTVTHAQDILEKTHNGKLCDLDGVK

PLILRDCSVAGWLLGNPMCDEFINVPEWSYIVEKANPANDLCYPGDFNDYEELKHLLSRINHFE

KIQIIPKNSWSSHEASLGVSSACPYQGKSSFFRNVVWLIKKNNAYPTIKRSYNNTNQEDLLVLW

GIHHPNDAAEQTRLYQNPTTYISVGTSTLNQRLVPKIATRSKVNGQNGRMEFFWTILKPNDAIN

FESNGNFIAPEYAYKIVKKGDSAIMKSELEYGNCNTKCQTPMGAINSSMPFHNIHPLTIGECPK

YVKSNRLVLATGLRNSPQRERRRKKRGLFGAIAGFIEGGWQGMVDGWYGYHHSNEQGSGYAADK

ESTQKAIDGVTNKVNSIIDKMNTQFEAVGREFNNLERRIENLNKKMEDGFLDVWTYNAELLVLM

ENERTLDFHDSNVKNLYDKVRLQLRDNAKELGNGCFEFYHKCDNECMESVRNGTYDYPQYSEEA

RLKREEISGVKLESIGTYQILSIYSTVASSLALAIMVAGLSLWMCSNGSLQCRICI

A/Vietnam/1203/04
(SEQ ID NO: 205)
MEKIVLLFAIVSLVKSDQICIGYHANNSTEQVDTIMEKNVTVTHAQDILEKKHNGKLCDLDGVK

PLILRDCSVAGWLLGNPMCDEFINVPEWSYIVEKANPVNDLCYPGDFNDYEELKHLLSRINHFE

KIQIIPKSSWSSHEASLGVSSACPYQGKSSFFRNVVWLIKKNSTYPTIKRSYNNTNQEDLLVLW

GIHHPNDAAEQTKLYQNPTTYISVGTSTLNQRLVPRIATRSKVNGQSGRMEFFWTILKPNDAIN

FESNGNFIAPEYAYKIVKKGDSTIMKSELEYGNCNTKCQTPMGAINSSMPFHNIHPLTIGECPK

YVKSNRLVLATGLRNSPQRERRRKKRGLFGAIAGFIEGGWQGMVDGWYGYHHSNEQGSGYAADK

ESTQKAIDGVTNKVNSIIDKMNTQFEAVGREFNNLERRIENLNKKMEDGFLDVWTYNAELLVLM

ENERTLDFHDSNVKNLYDKVRLQLRDNAKELGNGCFEFYHKCDNECMESVRNGTYDYPQYSEEA

RLKREEISGVKLESIGIYQILSIYSTVASSLALAIMVAGLSLWMCSNGSLQCRICI

A/Indonesia/5/05

(SEQ ID NO: 55)

MEKIVLLLAIVSLVKSDQICIGYHANNSTEQVDTIMEKNVTVTHAQDILEKTHNGKLCDLDGVK

PLILRDCSVAGWLLGNPMCDEFINVPEWSYIVEKANPTNDLCYPGSFNDYEELKHLLSRINHFE

KIQIIPKSSWSDHEASSGVSSACPYLGSPSFFRNVVWLIKKNSTYPTIKKSYNNTNQEDLLVLW

GIHHPNDAAEQTMLYQNPTTYISIGTSTLNQRLVPKIATRSKVNGQSGRMEFFWTILKPNDAIN

FESNGNFIAPEYAYKIVKKGDSAIMKSELEYGNCNTKCQTPMGAINSSMPFHNIHPLTIGECPK

YVKSNRLVLATGLRNSPQRESRRKKRGLFGAIAGFIEGGWQGMVDGWYGYHHSNEQGSGYAADK

ESTQKAIDGVTNKVNSIIDKMNTQFEAVGREFNNLERRIENLNKKMEDGFLDVWTYNAELLVLM

ENERTLDFHDSNVKNLYDKVRLQLRDNAKELGNGCFEFYHKCDNECMESIRNGTYNYPQYSEEA

RLKREEISGVKLESIGTYQILSIYSTVASSLALAIMMAGLSLWMCSNGSLQCRICI

A/Egypt/2786-NAMRU3/06

(SEQ ID NO: 206)

MEKIVLLLAIVSLVKSDQICIGYHANNSTEQVDTIMEKNVTVTHAQDILEKTHNGKLCDLDGVK

PLILRDCSVAGWLLGNPMCDEFLNVPEWSYIVEKINPANDLCYPGNFNDYEELKHLLSRINHFE

KIQIIPKSSWSDHEASSGVSSACPYQGRSSFFRNVVWLIKKDNAYPTIKRSYNNTNQEDLLVLW

GIHHPNDAAEQTRLYQNPTTYISVGTSTLNQRLVPKIATRSKVNGQSGRMEFFWTILKSNDAIN

FESNGNFIAPENAYKIVKKGDSTIMKSELEYGNCNTKCQTPIGAINSSMPFHNIHPLTIGECPK

YVKSNRLVLATGLRNSPQGERRRKKRGLFGAIAGFIEGGWQGMVDGWYGYHHSNEQGSGYAADK

ESTQKAIDGVTNKVNSIIDKMNTQFEAVGREFNNLERRIENLNKKMEDGFLDVWTYNAELLVLM

ENERTLDFHDSNVKNLYDKVRLQLRDNAKELGNGCFEFYHRCDNECMESVRNGTYDYPQYSEEA

RLKREEISGVKLESIGTYQILSIYSTVASSLALAIMVAGLFLWMCSNGSLQCRICI

The present invention also particularly encompasses the recognition that H5 HA polypeptide variants with alterations in the HA loop region, can show increased (or decreased) binding to human HA receptors as compared with a reference HA polypeptide (including, for example, an HA polypeptide of any of SEQ ID NO: 50, 51, and 53-55, 205 and 206).

BRIEF DESCRIPTION OF THE DRAWINGS

FIG. 1A-1C. Alignment of exemplary sequences of wild type HA. Sequences were obtained from the NCBI influenza virus sequence database (available through the world wide web at ncbi.nlm.nih.gov/genomes/FLU/FLU). H1_Av (SEQ ID NO: 1). H1_Hu1 (SEQ ID NO: 2). H1_Hu2 (SEQ ID NO: 3). H2_Av (SEQ ID NO: 4). H2_Hu (SEQ ID NO: 5). H3_Av (SEQ ID NO: 6). H3_Hu1 (SEQ ID NO: 7). H3_Hu2 (SEQ ID NO: 8). H4_Av (SEQ ID NO: 9). H5_Av1 (SEQ ID NO: 10). H5_Av2 (SEQ ID NO: 11). H6_Av (SEQ ID NO: 12). H7_Av (SEQ ID NO: 13). H8_Av (SEQ ID NO: 14). H9_Av (SEQ ID NO: 15). H10_Av (SEQ ID NO: 16). H11 Av (SEQ ID NO: 17). H12_Av (SEQ ID NO: 18). H13_Av (SEQ ID NO: 19). H14_Av (SEQ ID NO: 20). H15_Av (SEQ ID NO: 21). H16_Av (SEQ ID NO: 22).

FIG. 2A-B. Sequence alignment of HA glycan binding domain. Gray: conserved amino acids involved in binding to sialic acid. Red: particular amino acids involved in binding to Neu5Acα2-3/6Gal motifs. Yellow: amino acids that influence positioning of Q226 (137, 138) and E190 (186, 228). Green: amino acids involved in binding to other monosaccharides (or modifications) attached to Neu5Acα2-3/6Gal motif. The sequence for ASI30, APR34, ADU63, ADS97 and Viet04 were obtained from their respective crystal structures. The other sequences were obtained from SwissProt (us.expasy.org). Abbreviations: ADA76, A/duck/Alberta/35/76 (H1N1) (SEQ ID NO: 23); ASI30, A/Swine/Iowa/30 (H1N1) (SEQ ID NO: 24); APR34, A/Puerto Rico/8/34 (H1N1) (SEQ ID NO: 25); ASC18, A/South Carolina/1/18 (H1N1) (SEQ ID NO: 26); AT91, A/Texas/36/91 (H1N1) (SEQ ID NO: 27); ANY18, A/New York/1/18 (H1N1) (SEQ ID NO: 28); ADU63, A/Duck/Ukraine/1/63 (H3N8) (SEQ ID NO: 29); AAI68, A/Aichi/2/68 (H3N2) (SEQ ID NO: 30); AM99, A/Moscow/10/99 (H3N2) (SEQ ID NO: 31); ADS97, A/Duck/Singapore/3/97 (H5N3) (SEQ ID NO: 32); Viet04, A/Vietnam/1203/2004 (H5N1) (SEQ ID NO: 33).

FIG. 3. Sequence alignment illustrating conserved subsequences characteristic of H1 HA. FIG. 3A presents the same alignment that was presented in FIG. 1A, except that FIG. 3A indicates the presence of an additional conserved subsequence. FIG. 3B presents the same alignment that was presented in FIG. 1C, except that FIG. 3A indicates the presence of an additional conserved subsequence. FIG. 3A discloses SEQ ID NOS 208-229, respectively, in order of appearance. FIG. 3B discloses SEQ ID NOS 230-251, respectively, in order of appearance.

FIG. 4. Sequence alignment illustrating conserved subsequences characteristic of H3 HA. FIG. 4A presents the same alignment that was presented in FIG. 1A, except that FIG. 4A indicates the presence of an additional conserved subsequence. FIG. 4B presents the same alignment that was presented in FIG. 1C, except that FIG. 4A indicates the presence of an additional conserved subsequence. FIG. 4A discloses SEQ ID NOS 252-273, respectively, in order of appearance. FIG. 4B discloses SEQ ID NOS 274-295, respectively, in order of appearance.

FIG. 5A-1. Sequence alignment illustrating conserved subsequences characteristic of H5 HA. FIG. 5A-1 presents the same alignment that was presented in FIG. 1A, except that FIG. 5A-1 indicates the presence of an additional conserved subsequence. FIG. 5A-1 discloses SEQ ID NOS 296-317, respectively, in order of appearance.

FIG. 5A-2 presents the same alignment that was presented in FIG. 1C, except that FIG. 5A-2 indicates the presence of an additional conserved subsequence. FIG. 5A-2 discloses SEQ ID NOS 318-339, respectively, in order of appearance.

FIG. 5B1-B5 presents additional H5 HA sequence alignments. Consensus (SEQ ID NO: 34); AAL59142 (SEQ ID NO: 35); AAZ29963 (SEQ ID NO: 36); ABA70758 (SEQ ID NO: 37); ABB87042 (SEQ ID NO: 38); ABD14810 (SEQ ID NO: 39); ABD46740 (SEQ ID NO: 40); ABD85144 (SEQ ID NO: 41); and ABE97569 (SEQ ID NO: 42).

FIG. 5B-6 shows additional avian 4 (HA) H5N1 viral strains.

FIG. 6. Framework for understanding glycan receptor specificity. α2-3- and/or α2-6-linked glycans can adopt different topologies. According to the present invention, the ability of an HA polypeptide to bind to certain of these topologies confers upon it the ability to mediate infection of different hosts, for example, humans. As illustrated in Panel A of this figure, the present invention defines two particularly relevant topologies, a "cone" topology and an "umbrella" topology. The cone topology can be adopted by α2-3- and/or α2-6-linked glycans, and is typical of short oligosaccharides or branched oligosaccharides attached to a core (although this topology can be adopted by certain long oligosaccharides). The umbrella topology can only be adopted by α2-6-linked glycans (presumably due to the increased conformational plurality afforded by the extra C5-C6 bond that is present in the α2-6 linkage), and is predominantly adopted by long oligosaccharides or branched glycans with long oligosaccharide branches, particularly containing the motif Neu5Acα2-6Galβ1-3/4GlcNAc-. As described herein, ability of HA polypeptides to bind the umbrella glycan topology, confers binding to human receptors and/or ability to mediate infection of humans. Panel B of this Figure specifically shows the topology of α2-3 and α2-6 as governed by the glycosidic torsion angles of the trisaccharide motifs—Neu5Acα2-3Galβ1-3/4GlcNAc and Neu5Acα2-6Galβ1-4GlcNAc respectively. A parameter (θ)—angle between C2 atom of Neu5Ac and C1 atoms of the subsequent Gal and GlcNAc sugars in these trisaccharide motifs was defined to characterize the topology. Superimposition of the θ contour and the conformational maps of the α2-3 and α2-6 motifs shows that α2-3 motifs adopt 100% cone-like topology and α2-6 motifs sampled both cone-like and umbrella-like topologies (Panel C). In the cone-like topology sampled by α2-3 and α2-6, GlcNAc and subsequent sugars are positioned along a region spanning a cone. Interactions of HA with cone-like topology primarily involve contacts of amino acids at the numbered positions (based on H3 HA numbering) with Neu5Ac and Gal sugars. On the other hand, in umbrella-like topology, which is unique to α2-6, \ GlcNAc and subsequent sugars bend towards the HA binding site (as observed in HA-α2-6 co-crystal structures). Longer α2-6 oligosaccharides (e.g. at least a tetrasaccharide) would favor this conformation since it is stabilized by intra-sugar van der Waals contact between acetyl groups of GlcNAc and Neu5Ac. HA interactions with umbrella-like topology involve contacts of amino acids at the numbered positions (based on H3 HA numbering) with GlcNAc and subsequent sugars in addition to contacts with Neu5Ac and Gal sugars. Panel C of this Figure depicts conformational sampling of cone- and umbrella-like topology by α2-3 and α2-6. Sections (A)-(D) show the conformational (φ, ψ) maps of Neu5Acα2-3Gal, Neu5Acα2-6Gal, Galβ1-3GlcNAc, and Galβ1-4GlcNAc linkages, respectively. These maps obtained from GlycoMaps DB (available through the world wide web at glycosciences.de/modeling/glycomapsdb/) were generated using ab initio MD simulations using MM3 force field. Energy distribution is color coded starting from dark (representing highest energy) to light representing lowest energy. Encircled regions 1-5 represent (φ,ψ) values observed for the α2-3 and α2-6 oligosaccharides in the HA-glycan co-crystal structures. The trans conformation (encircled region 1) of Neu5Acα2-3Gal predominates in HA binding pocket with the exception of the co-crystal structure of A/Aichi/2/68 H3N2 HA with α2-3 where this conformation is gauche (encircled region 2). On the other hand, the cis conformation of Neu5Acα2-6Gal (encircled region 3) predominates in HA binding pocket. The cone-like topology is sampled by encircled regions 1 and 2 and the umbrella-like topology is sampled by encircled region 3. Sections (E)-(F) show sampling of cone-like and umbrella-like topologies by α2-3 and α2-6 motifs, respectively. The darker regions in the conformational maps were used as the outer boundaries to calculate the θ parameter (angle between C2 atom of Neu5Ac and C1 atoms of subsequent Gal and GlcNAc sugars) for a given set of (φ,ψ) values. Based on the energy cutoff, the value of θ>110° was used to characterize cone-like topology and θ<100° was used to characterize umbrella-like topology. Superimposition of the θ contour with the conformational energy map indicated that α2-3 motif adopts 100% cone-like topology since it was energetically unfavorable to adopt umbrella-like topology. On the other hand, the α2-6 motif sampled both the cone-like and umbrella-like topologies and this sampling was classified based on the ω angle (O—C6-C5-H5) of Neu5Acα2-6Gal linkage.

FIG. 8. Exemplary cone topologies. This Figure illustrates certain exemplary (but not exhaustive) glycan structures that adopt cone topologies.

FIG. 15: Viet0304-LS and Viet0304-RLS (equivalent to Ind505-LS) HAs were analyzed in a dose-dependent fashion on our glycan array comprising of representative avian and human receptors. Both mutants showed minimal α2-6 binding (binding signals observed only at high HA concentration), which contrasts with the high affinity α2-6 binding shared by human adapted HAs.

FIG. 18: Comparison of the RBS of the H5 HA mutants with that of H2N2 HA. Alb6_58_H2N2 (SEQ ID NO: 89): A/Albany/6/58 H2N2 HA; Viet1203_04_D (SEQ ID NO: 90): modified version of A/Vietnam/1203/04 HA; Viet1203_04_D_H2RBS (SEQ ID NO: 91): mutant of Viet1203_04_D with deletion at 130 and 13 amino acid substitutions; Viet1203_04_D_H2RBSmin (SEQ ID NO: 92): mutant of Viet1203_04_D with deletion at 130 and 7 substitutions; ckEgy_07 (SEQ ID NO: 93): A/chicken/Egypt/R2/2007 H5N1 HA that already has deletion at 130; ckEgy_07_H2RBS (SEQ ID NO: 94): mutant of ckEgy_07 with 8 substitutions; ckViet_08 (SEQ ID NO: 95): A/chicken/Vietnam/NCVD-093/2008 H5N1 HA that already has switch in charge at 192 and 193 positions; ckViet_08_H2RBS (SEQ ID NO: 96): mutant of ckViet_08 with deletion at 130 and 6 substitutions; ckViet_08H2RBSmin (SEQ ID NO: 97): mutant of ckViet_08 with deletion at 130 and 4 substitutions. The residue positions that are substituted are in bold and highlighted. The deletion in 130 loop is shown in bold highlighted. Glycosylation at 158 is highlighted.

FIG. 23. Sequence alignment of RBS of representative H2 and H5 HAs HA sequences from the pandemic H2N2 strain (A/Albany/6/58 or Alb58) (SEQ ID NO: 98), representative human isolates from 1997-2006 (A/Hong Kong/486/97 or HK_486_97 (SEQ ID NO: 105), A/Hong Kong/213/03 or HK_213_03 (SEQ ID NO: 104), A/Vietnam/1203/04 or Viet1203_04 (SEQ ID NO: 103), A/Indonesia/5/05 or Ind_5_05 (SEQ ID NO: 102), A/Egypt/2786-NAMRU3 or Egy2786-N3_06 (SEQ ID NO: 101)) along with the chosen H5 HA template (A/chicken/Egypt/R2/07 or ckEgy_07 (SEQ ID NO: 99)) for introducing LS mutation (ckEgy_07mutv5.3 (SEQ ID NO: 100)) are aligned.

FIG. 24. Glycan receptor-binding properties of ckEgy_07 and ckEgy_07 harboring LS amino acid changes Dose-dependent direct glycan-binding of HAs were performed on a glycan array platform comprising of representative human and avian receptors. A, the wild-type ckEgy_07 HA shows the typical specific and high affinity avian-receptor binding characteristic of other wild-type H5N1 HAs. B, Introduction of the LS mutations on this HA quantitatively shifts its specificity to human receptor (6'SLN-LN) and substantially reducing its avian receptor binding to a minimal level. C, binding of ckEgy_07 LS mutant to physiological human receptors expressed predominantly on apical surface of human tracheal tissue section. The human receptor specificity and affinity from the dose-dependent binding profile together with the human tracheal tissue staining of the mutant HA is such that it may be sufficient to confer aerosol transmission of H5N1 virus harboring this mutant HA in the context of other required changes (such as PB2).

FIG. 25: Analysis of effect of loss of glycosylation at the 158 position in the context of LS mutations on glycan receptor binding of H5 HA A, the ckEgy_07_LS mutant shows a quantitative human receptor switch resembling other pandemic HAs. B, the binding curve for A/California/04/2009 H1N1 HA adapted from previous study (S3) is shown for comparison. C, the T160A mutation in Viet03_04_ALS mutant removes glycosylation sequon at N158 leading to loss of glycosylation at this site. Although this mutant shows dramatic improvement in human receptor-binding, it retains most of its avian receptor-binding that is not characteristic of pandemic HAs and the ckEgy_07_LS mutant (in the top panel). D, LS amino acid mutations introduced in Egy_06 HA sequence that naturally lacks glycosylation at 158 also shows the same binding profile as Viet03_04_ALS mutant.

FIG. 26: Human-adaptive amino acid changes on H5N1 HA sequence that naturally acquired feature 2 A/chicken/Vietnam/NCVD-093/2008 avian H5N1 HA already acquired amino acid changes in 190-helix where 192 position typically comprising of Thr has mutated to Lys and 193 position typically comprising of Lys/Arg has mutated to Met. Introducing 6 amino acid changes and a deletion to match feature 1 (deletion in 130-loop+A130T) and feature 3 (S137R/S221P/Q226L/S227G/G228S) resulted in a mutant HA that quantitatively switched its preference to human receptors even in the presence of glycosylation at 158. However, introduction of the T160A loss of glycosylation change along with LS, without the 130-loop deletion results in dramatic reduction in binding to human and avian receptors (data not shown). Therefore, for these H5N1 HAs, the deletion in 130-loop is a more critical change than the loss of glycosylation in the context of LS mutation.

FIG. 28: Expanded nomenclature of glycans used in the glycan array Neu5Ac: N-acetyl D-neuraminic acid; Gal: D-galactose; GlcNAc: N-acetyl D-glucosamine. α/β: anomeric configuration of the pyranose sugars. All the sugars are linked via a spacer to biotin (-Sp-LC-LC-Biotin as described in, and available through the world wide web at, functionalglycomics.org/static/consortium/resources/resourcecored5).

DESCRIPTION OF HA SEQUENCE ELEMENTS

HA Sequence Element 1

HA Sequence Element 1 is a sequence element corresponding approximately to residues 97-185 (where residue positions are assigned using H3 HA as reference) of many HA proteins found in natural influenza isolates. This sequence element has the basic structure:

(SEQ ID NO. 106)
C (Y/F) P $X_1$ C $X_2$ W $X_3$ W $X_4$ H H P, wherein:
$X_1$ is approximately 30-45 amino acids long;
$X_2$ is approximately 5-20 amino acids long;
$X_3$ is approximately 25-30 amino acids long; and
$X_4$ is approximately 2 amino acids long.

In some embodiments, $X_1$ is about 35-45, or about 35-43, or about 35, 36, 37, 38, 38, 40, 41, 42, or 43 amino acids long. In some embodiments, $X_2$ is about 9-15, or about 9-14, or about 9, 10, 11, 12, 13, or 14 amino acids long. In some embodiments, $X_3$ is about 26-28, or about 26, 27, or 28 amino acids long. In some embodiments, $X_4$ has the sequence (G/A) (I/V). In some embodiments, $X_4$ has the sequence GI; in some embodiments, $X_4$ has the sequence GV; in some embodiments, $X_4$ has the sequence AI; in some embodiments, $X_4$ has the sequence AV. In some embodiments, HA Sequence Element 1 comprises a disulfide bond. In some embodiments, this disulfide bond bridges residues corresponding to positions 97 and 139 (based on the canonical H3 numbering system utilized herein).

In some embodiments, and particularly in H1 polypeptides, $X_1$ is about 43 amino acids long, and/or $X_2$ is about 13 amino acids long, and/or $X_3$ is about 26 amino acids long. In some embodiments, and particularly in H1 polypeptides, HA Sequence Element 1 has the structure:

(SEQ ID NO. 107)
C Y P $X_{1A}$ T (A/T) (A/S) C $X_2$ W $X_3$ W $X_4$ H H P, wherein:
$X_{1A}$ is approximately 27-42, or approximately 32-42, or approximately 32-40, or approximately 26-41, or approximately 31-41, or approximately 31-39, or approximately 31, 32, 33, 34, 35, 36, 37, 38, 39, or 40 amino acids long, and $X_2$—$X_4$ are as above.

In some embodiments, and particularly in H1 polypeptides, HA Sequence Element 1 has the structure:

(SEQ ID NO. 108)
C Y P $X_{1A}$ T (A/T) (A/S) C $X_2$ W (I/L) (TN) $X_{3A}$ W $X_4$ H H P, wherein:
$X_{1A}$ is approximately 27-42, or approximately 32-42, or approximately 32-40, or approximately 32, 33, 34, 35, 36, 37, 38, 39, or 40 amino acids long,
$X_{3A}$ is approximately 23-28, or approximately 24-26, or approximately 24, 25, or 26 amino acids long, and $X_2$ and $X_4$ are as above.

Figure 1:
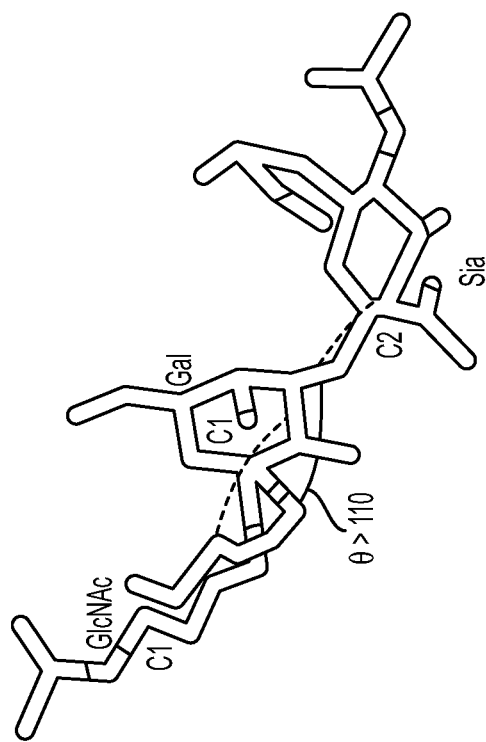
Figure 2:
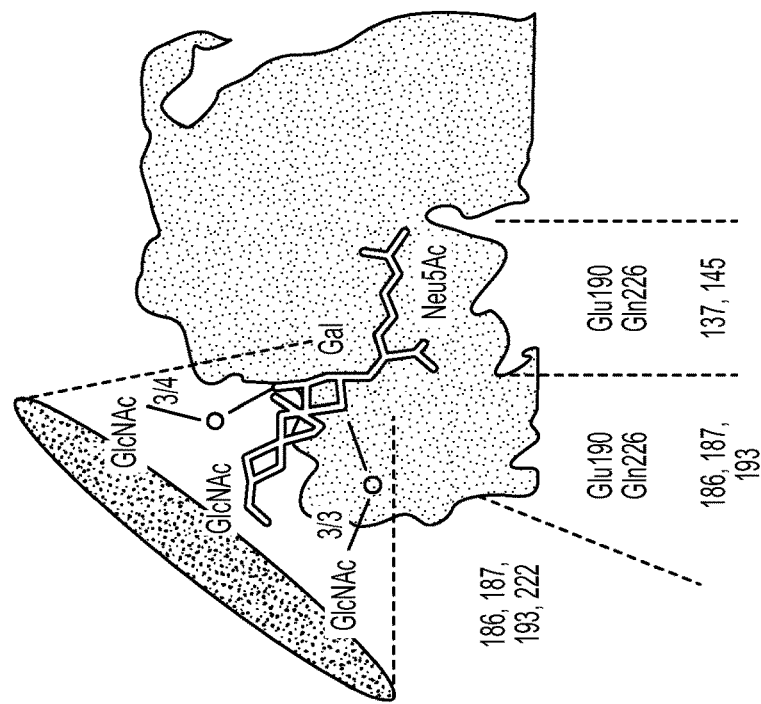

In some embodiments, and particularly in H1 polypeptides, HA Sequence Element 1 includes the sequence:

(SEQ ID NO. 109)
Q L S S I S S F E K, typically within $X_1$, (including within $X_{1A}$) and especially beginning about residue 12 of $X_1$ (as illustrated, for example, in FIGS. 1-3).

In some embodiments, and particularly in H3 polypeptides, $X_1$ is about 39 amino acids long, and/or $X_2$ is about 13 amino acids long, and/or $X_3$ is about 26 amino acids long.

In some embodiments, and particularly in H3 polypeptides, HA Sequence Element 1 has the structure:

(SEQ ID NO. 110)
C Y P $X_{1A}$ S (S/N) (A/S) C $X_2$ W $X_3$ W $X_4$ H H P, wherein:
$X_{1A}$ is approximately 27-42, or approximately 32-42, or approximately 32-40, or approximately 23-38, or approximately 28-38, or approximately 28-36, or approximately 28, 29, 30, 31, 32, 33, 34, 35, 36, 37, 38, 39, or 40 amino acids long, and $X_2$—$X_4$ are as above.

In some embodiments, and particularly in H3 polypeptides, HA Sequence Element 1 has the structure:

(SEQ ID NO. 111)
C Y P $X_{1A}$ S (S/N) (A/S) C $X_2$ W L (T/H) $X_{3A}$ W $X_4$ H H P, wherein:
$X_{1A}$ is approximately 27-42, or approximately 32-42, or approximately 32-40, or approximately 32, 33, 34, 35, 36, 37, 38, 39, or 40 amino acids long,
$X_{3A}$ is approximately 23-28, or approximately 24-26, or approximately 24, 25, or 26 amino acids long, and $X_2$ and $X_4$ are as above.

In some embodiments, and particularly in H3 polypeptides, HA Sequence Element 1 includes the sequence:

(SEQ ID NO. 112)
(L/I) (V/I) A S S G T L E F, typically within $X_1$ (including within $X_{1A}$), and especially beginning about residue 12 of $X_1$ (as illustrated, for example, in FIGS. 1, 2 and 4).

In some embodiments, and particularly in H5 polypeptides, $X_1$ is about 42 amino acids long, and/or $X_2$ is about 13 amino acids long, and/or $X_3$ is about 26 amino acids long.

In some embodiments, and particularly in H5 polypeptides, HA Sequence Element 1 has the structure:

(SEQ ID NO. 113)
C Y P $X_{1A}$ S S A C $X_2$ W $X_3$ W $X_4$ H H P, wherein:
$X_{1A}$ is approximately 27-42, or approximately 32-42, or approximately 32-40, or approximately 23-38, or approximately 28-38, or approximately 28-36, or approximately 28, 29, 30, 31, 32, 33, 34, 35, 36, 37, 38, 39, or 40 amino acids long, and $X_2$ and $X_4$ are as.

In some embodiments, and particularly in H5 polypeptides, HA Sequence Element 1 has the structure:

$$C\ Y\ P\ X_{1A}\ S\ S\ A\ C\ X_2\ W\ L\ I\ X_{3A}\ W\ X_4\ H\ H\ P, \quad \text{(SEQ ID NO. 114)}$$

wherein:

$X_{1A}$ is approximately 27-42, or approximately 32-42, or approximately 32-40, or approximately 32, 33, 34, 35, 36, 37, 38, 39, or 40 amino acids long, and $X_{3A}$ is approximately 23-28, or approximately 24-26, or approximately 24, 25, or 26 amino acids long, and $X_2$ and $X_4$ are as above.

In some embodiments, and particularly in H5 polypeptides, HA Sequence Element 1 is extended (i.e., at a position corresponding to residues 186-193) by the sequence:

$$N\ D\ A\ A\ E\ X\ X\ (K/R) \quad \text{(SEQ ID NO. 115)}$$

Figures 1, 9A:
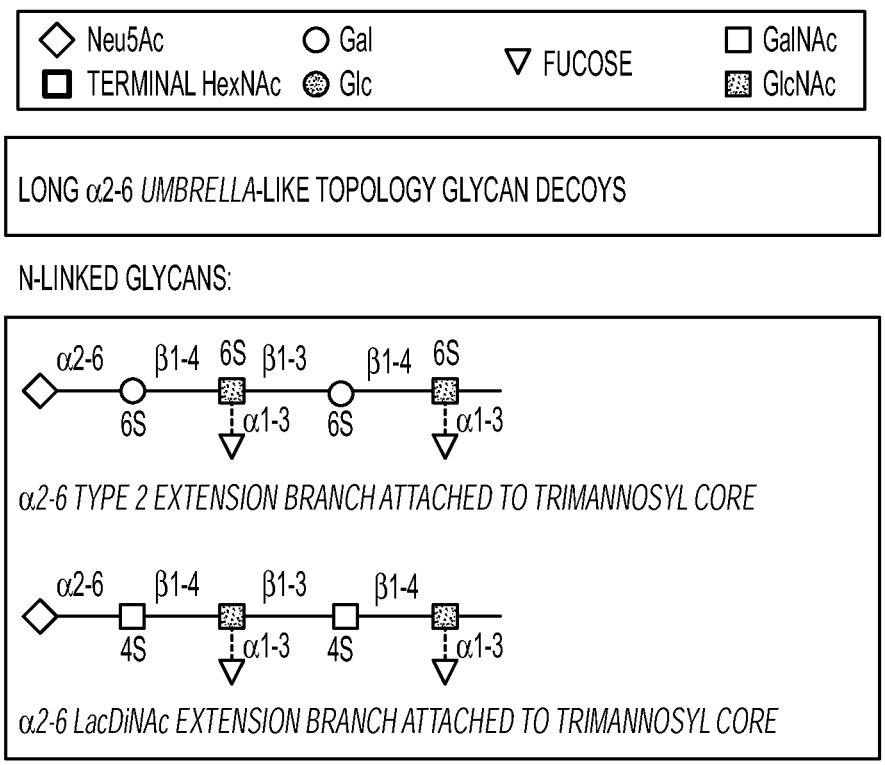
Figures 2, 9A:
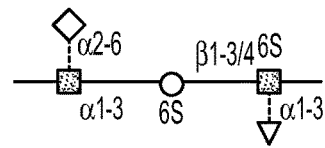
Figures 5, 9A:
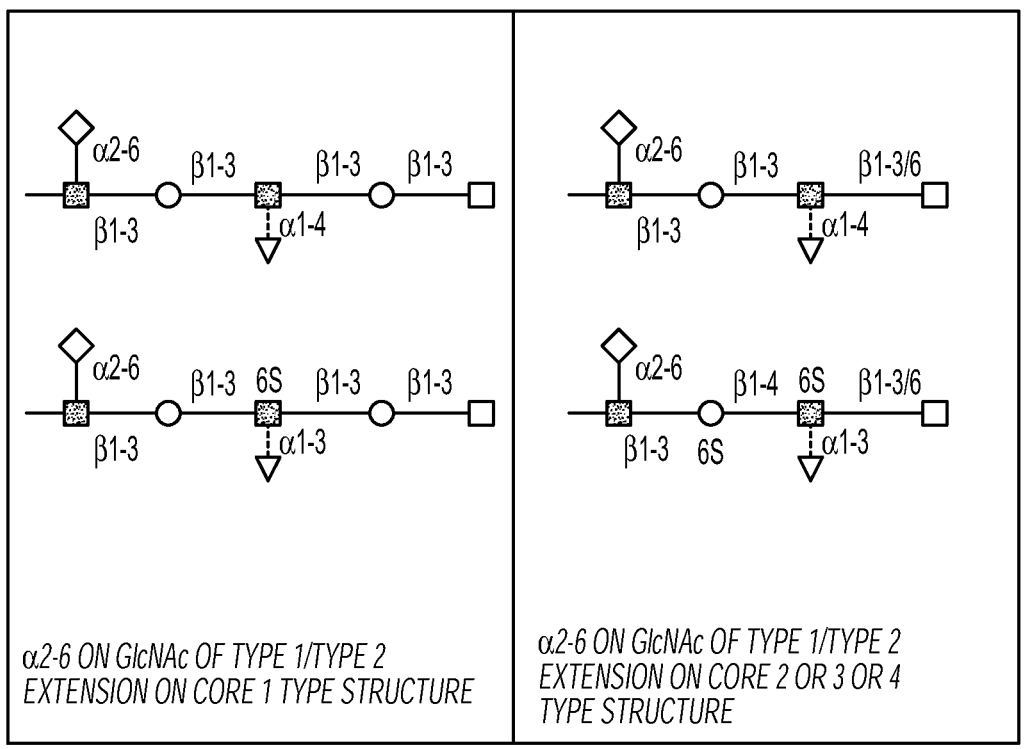
Figure 9A:
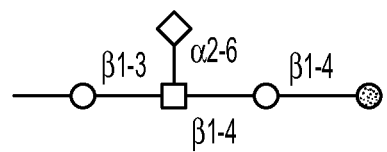
FIG. 9. Exemplary umbrella topologies. (A) Certain exemplary (but not exhaustive) N- and O-linked glycan structures that can adopt umbrella topologies. (B) Certain exemplary (but not exhaustive) O-linked glycan structures that can adopt umbrella topologies.
Figure 7:
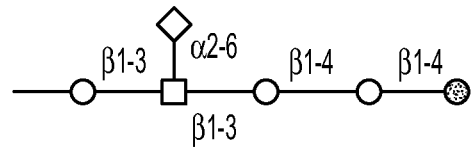
Figure 9B:
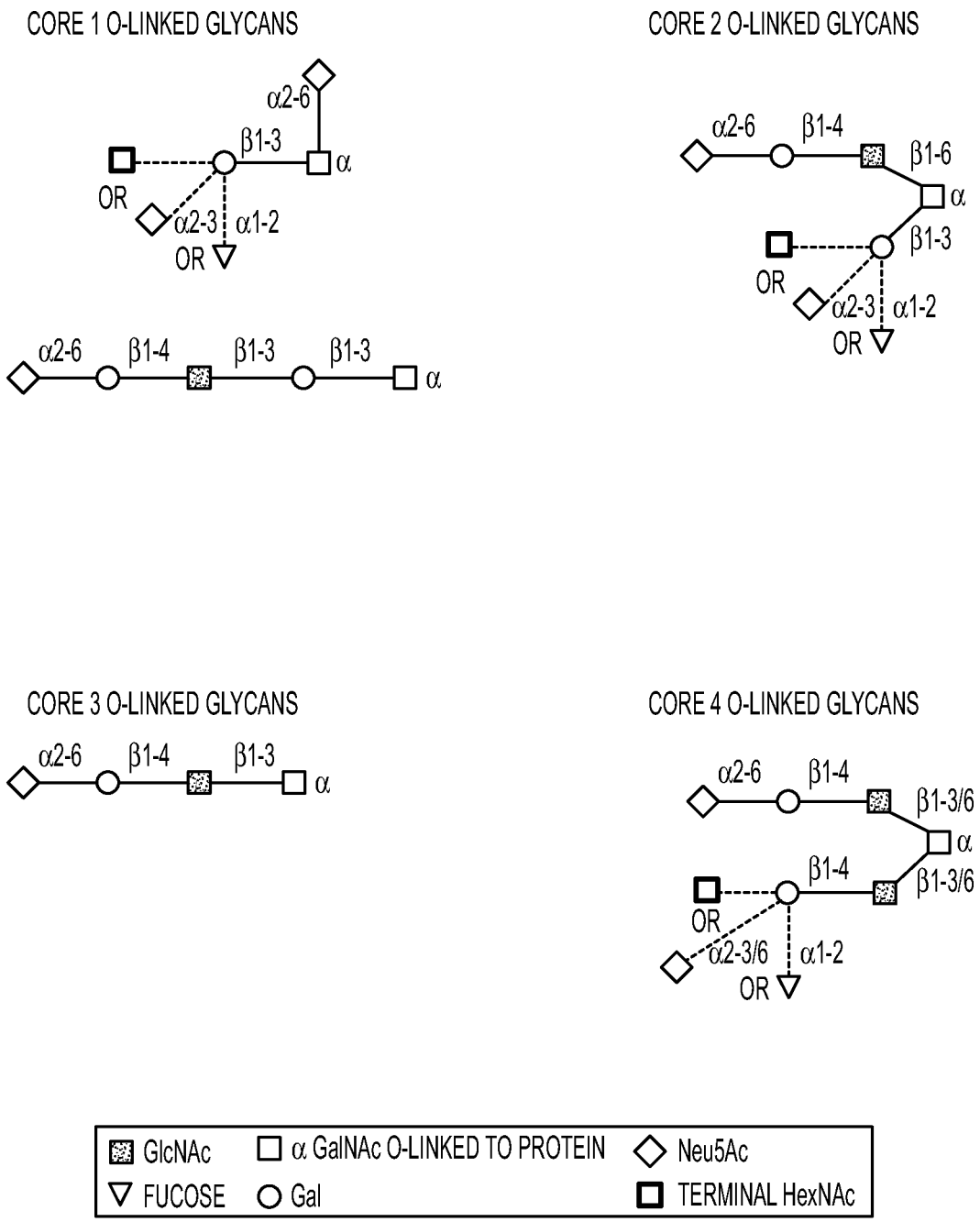

In some embodiments, and particularly in H5 polypeptides, HA Sequence Element 1 includes the sequence:

$$Y\ E\ E\ L\ K\ H\ L\ X\ S\ X\ X\ N\ H\ F\ E\ K, \quad \text{(SEQ ID NO. 116)}$$

typically within $X_1$, and especially beginning about residue 6 of $X_1$ (as illustrated, for example, in FIGS. 1, 2, and 5).

HA Sequence Element 2

HA Sequence Element 2 is a sequence element corresponding approximately to residues 324-340 (again using a numbering system based on H3 HA) of many HA proteins found in natural influenza isolates. This sequence element has the basic structure:

$$G\ A\ I\ A\ G\ F\ I\ E \quad \text{(SEQ ID NO. 117)}$$

In some embodiments, HA Sequence Element 2 has the sequence:

$$P\ X_1\ G\ A\ I\ A\ G\ F\ I\ E, \quad \text{(SEQ ID NO. 118)}$$

wherein:

$X_1$ is approximately 4-14 amino acids long, or about 8-12 amino acids long, or about 12, 11, 10, 9 or 8 amino acids long. In some embodiments, this sequence element provides the HA0 cleavage site, allowing production of HA1 and HA2.

In some embodiments, and particularly in H1 polypeptides, HA Sequence Element 2 has the structure:

$$P\ S\ (I/V)\ Q\ S\ R\ X_{1A}\ G\ A\ I\ A\ G\ F\ I\ E, \quad \text{(SEQ ID NO. 119)}$$

$X_{1A}$ is approximately 3 amino acids long; in some embodiments, $X_{1A}$ is G (L/I) F.

In some embodiments, and particularly in H3 polypeptides, HA Sequence Element 2 has the structure:

$$P\ X\ K\ X\ T\ R\ X_{1A}\ G\ A\ I\ A\ G\ F\ I\ E, \quad \text{(SEQ ID NO. 120)}$$

$X_{1A}$ is approximately 3 amino acids long; in some embodiments, $X_{1A}$ is G (L/I) F.

In some embodiments, and particularly in H5 polypeptides, HA Sequence Element 2 has the structure:

$$P\ Q\ R\ X\ X\ X\ R\ X\ X\ R\ X_{1A}\ G\ A\ I\ A\ G\ F\ I\ E, \quad \text{(SEQ ID NO. 121)}$$

wherein:

$X_{1A}$ is approximately 3 amino acids long; in some embodiments, $X_{1A}$ is G (L/I) F.

Definitions

Affinity: As is known in the art, "affinity" is a measure of the tightness with a particular ligand (e.g., an HA polypeptide) binds to its partner (e.g., and HA receptor). Affinities can be measured in different ways.

Binding: It will be understood that the term "binding", as used herein, typically refers to a non-covalent association between or among agents. In many embodiments herein, binding is addressed with respect to particular glycans (e.g., umbrella topology glycans or cone topology glycans). It will be appreciated by those of ordinary skill in the art that such binding may be assessed in any of a variety of contexts. In some embodiments, binding is assessed with respect to free glycans. In some embodiments, binding is assessed with respect to glycans attached (e.g., covalently linked to) a carrier. In some such embodiments, the carrier is a polypeptide. In some embodiments, binding is assessed with respect to glycans attached to an HA receptor. In such embodiments, reference may be made to receptor binding or to glycan binding.

Binding agent: In general, the term "binding agent" is used herein to refer to any entity that binds to glycans (e.g., to umbrella-topology glycans) as described herein. Binding agents may be of any chemical type. In some embodiments, binding agents are polypeptides (including, e.g., antibodies or antibody fragments); in some such embodiments, binding agents are HA polypeptides and/or variants thereof and/or characteristic portions thereof; in some embodiments, binding agents are polypeptides whose amino acid sequence does not include an HA characteristic sequence (i.e., "Non-HA polypeptides"). In some embodiments, binding agents are small molecules. In some embodiments, binding agents are nucleic acids. In some embodiments, binding agents are aptamers. In some embodiments, binding agents are polymers; in some embodiments, binding agents are non-polymeric. In some embodiments, binding agents are carbohydrates. In some embodiments, binding agents are lectins. In some embodiments, binding agents as described herein bind to sialylated glycans having an umbrella-like topology. In some embodiments, binding agents bind to umbrella-topology glycans with high affinity and/or specificity. In some embodiments, binding agents show a binding preference for umbrella-topology glycans as compared with cone-topology glycans. In some embodiments, binding agents compete with hemagglutinin for binding to glycans on hemagglutinin receptors. In some embodiments, binding agents compete with hemagglutinin for binding to umbrella-topology glycans. In some embodiments, a binding agent provided herein is an umbrella topology blocking agent. In some embodiments, a binding agent provided herein is an umbrella topology specific blocking agent. In some embodiments, binding agents bind to umbrella topology glycan mimics.

Biologically active: As used herein, the phrase "biologically active" refers to a characteristic of any agent that has activity in a biological system, and particularly in an organism. For instance, an agent that, when administered to an organism, has a biological effect on that organism, is considered to be biologically active. In some embodiments, where a protein or polypeptide is biologically active, a portion of that protein or polypeptide that shares at least one biological activity of the protein or polypeptide is typically referred to as a "biologically active" portion.

Characteristic portion: As used herein, the phrase a "characteristic portion" of a protein or polypeptide is one that contains a continuous stretch of amino acids, or a collection of continuous stretches of amino acids, that together are characteristic of a protein or polypeptide. Each such continuous stretch generally will contain at least two amino acids. Furthermore, those of ordinary skill in the art will appreciate that typically at least 5, at least 10, at least 15, at least 20 or more amino acids are required to be characteristic of a protein. In general, a characteristic portion is one that, in addition to the sequence identity specified above, shares at least one functional characteristic with the relevant intact protein.

Characteristic sequence: A "characteristic sequence" is a sequence that is found in all members of a family of polypeptides or nucleic acids, and therefore can be used by those of ordinary skill in the art to define members of the family.

Figure 6A:
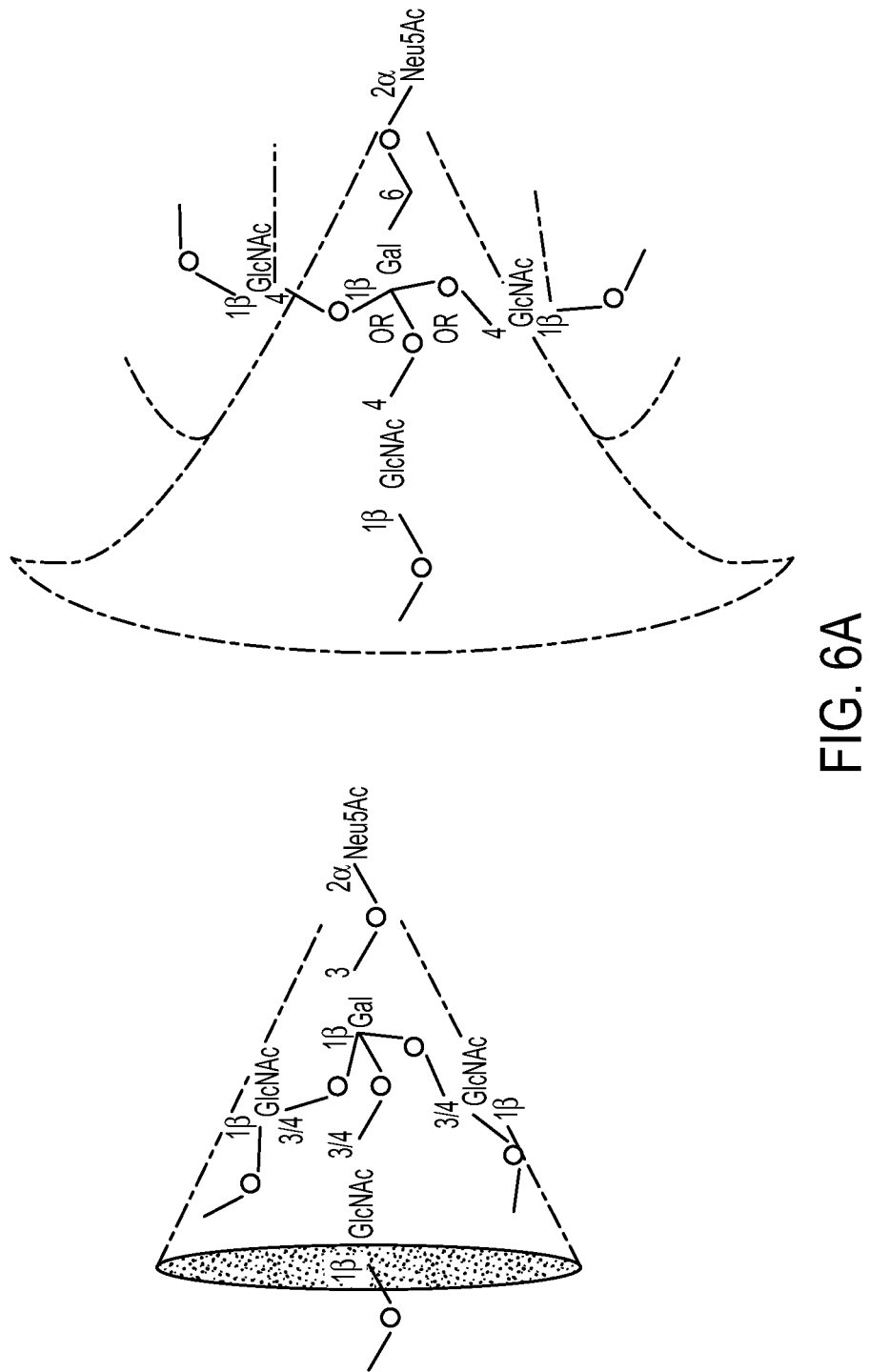
Figure 6B:
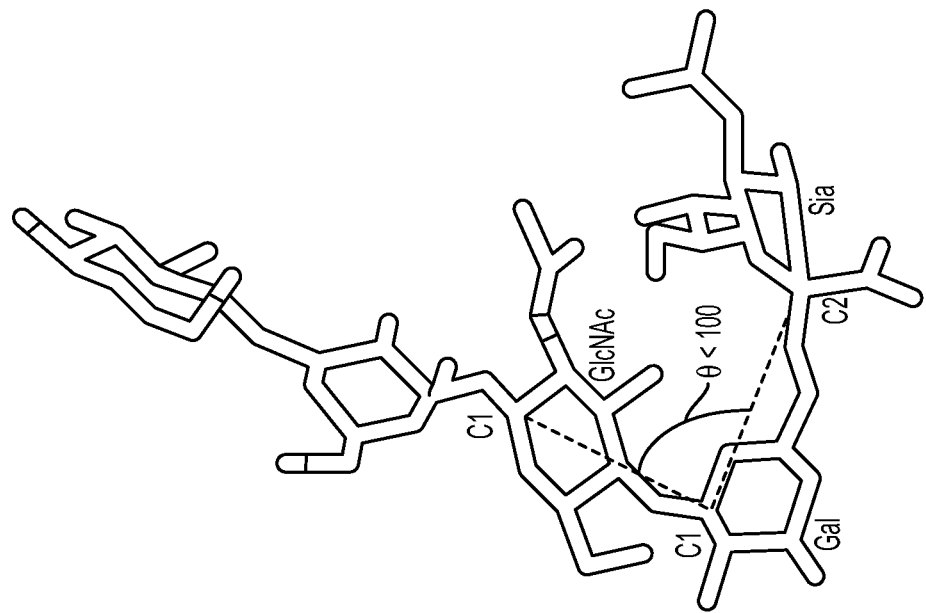
Figure 6B:
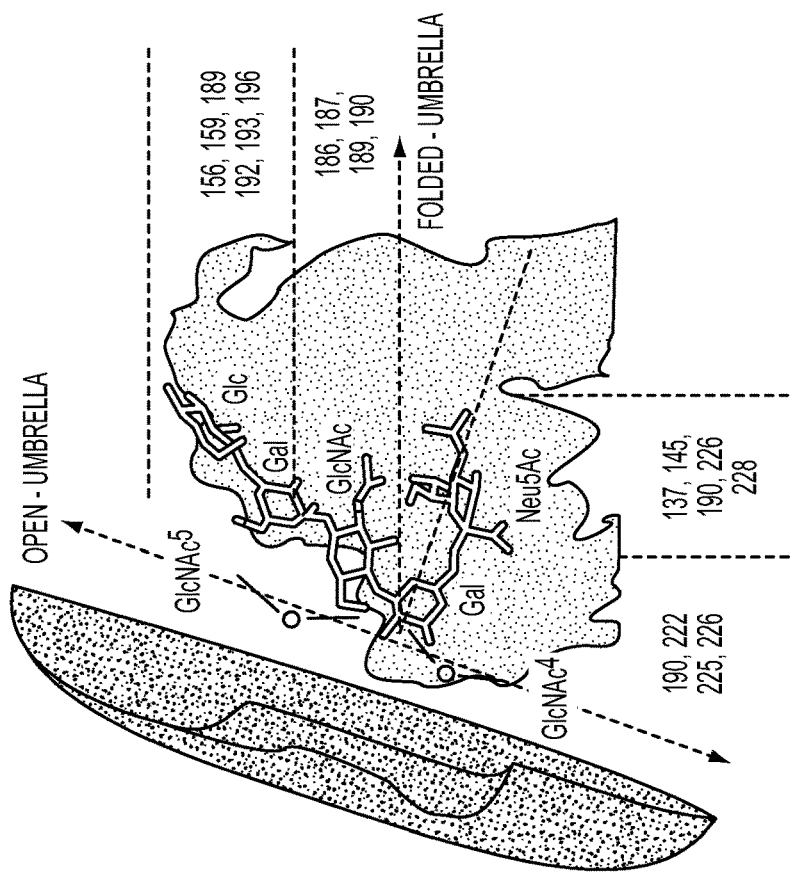

Cone topology: The phrase "cone topology" is used herein to refer to a 3-dimensional arrangement adopted by certain glycans and in particular by glycans on HA receptors. As illustrated in FIG. 6, the cone topology can be adopted by α2-3 sialylated glycans or by α2-6 sialylated glycans, and is typical of short oligonucleotide chains, though some long oligonucleotides can also adopt this conformation. The cone topology is characterized by the glycosidic torsion angles of Neu5Acα2-3Gal linkage which samples three regions of minimum energy conformations given by $\phi$ (C1-C2-O—C3/C6) value of about –60, about 60, or about 180 and $\psi$ (C2-O—C3/C6-H3/C5) samples –60 to 60 (FIG. 11). FIG. 8 presents certain representative (though not exhaustive) examples of glycans that adopt a cone topology.

Corresponding to: As used herein, the term "corresponding to" is often used to designate the position/identity of an amino acid residue in an HA polypeptide. Those of ordinary skill will appreciate that, for purposes of simplicity, a canonical numbering system (based on wild type H3 HA) is utilized herein (as illustrated, for example, in FIGS. 1-5), so that an amino acid "corresponding to" a residue at position 190, for example, need not actually be the $190^{th}$ amino acid in a particular amino acid chain but rather corresponds to the residue found at 190 in wild type H3 HA; those of ordinary skill in the art readily appreciate how to identify corresponding amino acids.

Degree of separation removed: As used herein, amino acids that are a "degree of separation removed" are HA amino acids that have indirect effects on glycan binding. For example, one-degree-of-separation-removed amino acids may either: (1) interact with the direct-binding amino acids; and/or (2) otherwise affect the ability of direct-binding amino acids to interact with glycan that is associated with host cell HA receptors; such one-degree-of-separation-re- moved amino acids may or may not directly bind to glycan themselves. Two-degree-of-separation-removed amino acids either (1) interact with one-degree-of-separation-removed amino acids; and/or (2) otherwise affect the ability of the one-degree-of-separation-removed amino acids to interact with direct-binding amino acids, etc.

Direct-binding amino acids: As used herein, the phrase "direct-binding amino acids" refers to HA polypeptide amino acids which interact directly with one or more glycans that is associated with host cell HA receptors.

Engineered: The term "engineered", as used herein, describes a polypeptide whose amino acid sequence has been selected by man. For example, an engineered HA polypeptide has an amino acid sequence that differs from the amino acid sequences of HA polypeptides found in natural influenza isolates. In some embodiments, an engineered HA polypeptide has an amino acid sequence that differs from the amino acid sequence of HA polypeptides included in the NCBI database.

H1 polypeptide: An "H1 polypeptide", as that term is used herein, is an HA polypeptide whose amino acid sequence includes at least one sequence element that is characteristic of H1 and distinguishes H1 from other HA subtypes. Representative such sequence elements can be determined by alignments such as, for example, those illustrated in FIGS. 1-3 and include, for example, those described herein with regard to H1-specific embodiments of HA Sequence Elements.

H3 polypeptide: An "H3 polypeptide", as that term is used herein, is an HA polypeptide whose amino acid sequence includes at least one sequence element that is characteristic of H3 and distinguishes H3 from other HA subtypes. Representative such sequence elements can be determined by alignments such as, for example, those illustrated in FIGS. 1, 2, and 4 and include, for example, those described herein with regard to H3-specific embodiments of HA Sequence Elements.

H5 polypeptide: An "H5 polypeptide", as that term is used herein, is an HA polypeptide whose amino acid sequence includes at least one sequence element that is characteristic of H5 and distinguishes H5 from other HA subtypes. Representative such sequence elements can be determined by alignments such as, for example, those illustrated in FIGS. 1, 2, and 5 and include, for example, those described herein with regard to H5-specific embodiments of HA Sequence Elements.

HX polypeptide: An "HX polypeptide", as that term is used herein, is an HA polypeptide whose amino acid sequence includes at least one sequence element that is characteristic of HX and distinguishes HX from other HA subtypes, wherein "X" refers to the numbering of the HA subtype (e.g., wherein when "X"=1, 2, 3, 4, 5, 6, 7, 8, 9, 10, 11, 12, 13, 14, 15, or 16, "HX"=H1, H2, H3, H4, H5, H6, H7, H8, H9, H10, H11, H12, H13, H14, H15, or H16, respectively).

Hemagglutinin (HA) polypeptide: As used herein, the term "hemagglutinin polypeptide" (or "HA polypeptide') refers to a polypeptide whose amino acid sequence includes at least one characteristic sequence of HA. A wide variety of HA sequences from influenza isolates are known in the art; indeed, the National Center for Biotechnology Information (NCBI) maintains a database (available through the world wide web at ncbi.nlm.nih.gov/genomes/FLU/flu) that, as of the filing of the present application included 9796 HA sequences. Those of ordinary skill in the art, referring to this database, can readily identify sequences that are characteristic of HA polypeptides generally, and/or of particular HA polypeptides (e.g., H1, H2, H3, H4, H5, H6, H7, H8, H9, H10, H11, H12, H13, H14, H15, or H16 polypeptides); or of HAs that mediate infection of particular hosts, e.g., avian, camel, canine, cat, civet, environment, equine, human, leopard, mink, mouse, seal, stone martin, swine, tiger, whale, etc. For example, in some embodiments, an HA polypeptide includes one or more characteristic sequence elements found between about residues 97 and about 185, about 324 and about 340, about 96 and about 100, and/or about 130 and about 230 of an HA protein found in a natural isolate of an influenza virus. In some embodiments, an HA polypeptide has an amino acid sequence comprising at least one of HA Sequence Elements 1 and 2, as defined herein. In some embodiments, an HA polypeptide has an amino acid sequence comprising HA Sequence Elements 1 and 2, in some embodiments separated from one another by about 100 to about 200, or by about 125 to about 175, or about 125 to about 160, or about 125 to about 150, or about 129 to about 139, or about 129, about 130, about 131, about 132, about 133, about 134, about 135, about 136, about 137, about 138, or about 139 amino acids. In some embodiments, an HA polypeptide has an amino acid sequence that includes residues at positions within the regions 96-100 and/or 130-230 that participate in glycan binding. For example, many HA polypeptides include one or more of the following residues: Tyr98, Ser/Thr136, Trp153, His183, and Leu/Ile194. In some embodiments, an HA polypeptide includes at least 2, 3, 4, or all 5 of these residues.

Isolated: The term "isolated", as used herein, refers to an agent or entity that has either (i) been separated from at least some of the components with which it was associated when initially produced (whether in nature or in an experimental setting); or (ii) produced by the hand of man. Isolated agents or entities may be separated from at least about 10%, at least about 20%, at least about 30%, at least about 40%, at least about 50%, at least about 60%, at least about 70%, at least about 80%, at least about 90%, or more of the other components with which they were initially associated. In some embodiments, isolated agents are more than 90%, 91%, 92%, 93%, 94%, 95%, 96%, 97%, 98%, 99% pure.

Linkage Specific Blocking Agent (LSBA): As used herein, the term "linkage specific blocking agent" refers to an agent which binds to an HA receptor having an α2-6 sialylated glycan. In some embodiments, an LSBA selectively binds to an HA receptor having an α2-6 sialylated glycan with at least about 40, 50, or 75% of the affinity of that for an HA receptor having an α2-3 sialylated glycan. In some embodiments, an LSBA selectively binds to an HA receptor having an α2-6 sialylated glycan with at least about 2, 4, 5, or 10 times greater affinity than that for an HA receptor having an α2-3 sialylated glycan. In some embodiments, an LSBA has an affinity for an α2-6 sialylated glycan that is at least 50, 100, 150, or 200% of its affinity for an α2-3 sialylated glycan. In some embodiments, an LSBA may compete with hemagglutinin for binding to an HA receptor. For example, an LSBA may selectively inhibit the binding of an influenza virus particle (e.g., human or avian influenza virus) to an HA receptor based on the linkage characteristics (e.g., α2-6 sialylated glycan or α2-3 sialylated glycan). In some embodiments, an LSBA is a polypeptide. In some such embodiments, an LSBA polypeptide has an amino acid sequence that is substantially identical or substantially homologous to that of a naturally-occurring polypeptide. In some embodiments, an LSBA polypeptide is an HA polypeptide. In some embodiments, an LSBA polypeptide is a naturally-occurring HA polypeptide, or a fragment thereof. In some embodiments, an LSBA polypeptide has an amino acid sequence that is not related to that of an HA polypeptide. In some embodiments, an LSBA polypeptide is an antibody or fragment thereof. In some embodiments, an LSBA polypeptide is a lectin (e.g., SNA-1). In some embodiments, an LSBA is not a polypeptide. In some embodiments, an LSBA is a small molecule. In some embodiments, an LSBA is a nucleic acid.

Long oligosaccharide: For purposes of the present disclosure, an oligosaccharide is typically considered to be "long" if it includes at least one linear chain that has at least four saccharide residues.

Non-natural amino acid: The phrase "non-natural amino acid" refers to an entity having the chemical structure of an amino acid (i.e.,:

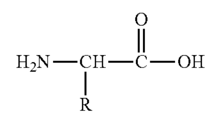

and therefore being capable of participating in at least two peptide bonds, but having an R group that differs from those found in nature. In some embodiments, non-natural amino acids may also have a second R group rather than a hydrogen, and/or may have one or more other substitutions on the amino or carboxylic acid moieties.

Polypeptide: A "polypeptide", generally speaking, is a string of at least two amino acids attached to one another by a peptide bond. In some embodiments, a polypeptide may include at least 3-5 amino acids, each of which is attached to others by way of at least one peptide bond. Those of ordinary skill in the art will appreciate that polypeptides sometimes include "non-natural" amino acids or other entities that nonetheless are capable of integrating into a polypeptide chain, optionally.

Pure: As used herein, an agent or entity is "pure" if it is substantially free of other components. For example, a preparation that contains more than about 90% of a particular agent or entity is typically considered to be a pure preparation. In some embodiments, an agent or entity is at least 91%, at least 92%, at least 93%, at least 94%, at least 95%, at least 96%, at least 97%, at least 98%, or at least 99% pure.

Short oligosaccharide: For purposes of the present disclosure, an oligosaccharide is typically considered to be "short" if it has fewer than 4, or certainly fewer than 3, residues in any linear chain.

Specificity: As is known in the art, "specificity" is a measure of the ability of a particular ligand (e.g., an HA polypeptide) to distinguish its binding partner (e.g., a human HA receptor, and particularly a human upper respiratory tract HA receptor) from other potential binding partners (e.g., an avian HA receptor).

Substantial homology: The phrase "substantial homology" is used herein to refer to a comparison between amino acid or nucleic acid sequences. As will be appreciated by those of ordinary skill in the art, two sequences are generally considered to be "substantially homologous" if they contain homologous residues in corresponding positions. Homologous residues may be identical residues. Alternatively, homologous residues may be non-identical residues will appropriately similar structural and/or functional characteristics. For example, as is well known by those of ordinary skill in the art, certain amino acids are typically classified as "hydrophobic" or "hydrophilic" amino acids, and/or as having "polar" or "non-polar" side chains. Substitution of one amino acid for another of the same type may often be considered a "homologous" substitution. Typical amino acid categorizations are summarized below:

| Alanine | Ala | A | nonpolar | neutral | 1.8 |
|---|---|---|---|---|---|
| Arginine | Arg | R | polar | positive | −4.5 |
| Asparagine | Asn | N | polar | neutral | −3.5 |
| Aspartic acid | Asp | D | polar | negative | −3.5 |
| Cysteine | Cys | C | nonpolar | neutral | 2.5 |
| Glutamic acid | Glu | E | polar | negative | −3.5 |
| Glutamine | Gln | Q | polar | neutral | −3.5 |
| Glycine | Gly | G | nonpolar | neutral | −0.4 |
| Histidine | His | H | polar | positive | −3.2 |
| Isoleucine | Ile | I | nonpolar | neutral | 4.5 |
| Leucine | Leu | L | nonpolar | neutral | 3.8 |
| Lysine | Lys | K | polar | positive | −3.9 |
| Methionine | Met | M | nonpolar | neutral | 1.9 |
| Phenylalanine | Phe | F | nonpolar | neutral | 2.8 |
| Proline | Pro | P | nonpolar | neutral | −1.6 |
| Serine | Ser | S | polar | neutral | −0.8 |
| Threonine | Thr | T | polar | neutral | −0.7 |
| Tryptophan | Trp | W | nonpolar | neutral | −0.9 |
| Tyrosine | Tyr | Y | polar | neutral | −1.3 |
| Valine | Val | V | nonpolar | neutral | 4.2 |

| Ambiguous Amino Acids | 3-Letter | 1-Letter |
|---|---|---|
| Asparagine or aspartic acid | Asx | B |
| Glutamine or glutamic acid | Glx | Z |
| Leucine or Isoleucine | Xle | J |
| Unspecified or unknown amino acid | Xaa | X |

As is well known in this art, amino acid or nucleic acid sequences may be compared using any of a variety of algorithms, including those available in commercial computer programs such as BLASTN for nucleotide sequences and BLASTP, gapped BLAST, and PSI-BLAST for amino acid sequences. Exemplary such programs are described in Altschul, et al., Basic local alignment search tool, *J. Mol. Biol.*, 215(3): 403-410, 1990; Altschul, et al., *Methods in Enzymology*; Altschul, et al., "Gapped BLAST and PSI-BLAST: a new generation of protein database search programs", *Nucleic Acids Res.* 25:3389-3402, 1997; Baxevanis, et al., *Bioinformatics: A Practical Guide to the Analysis of Genes and Proteins*, Wiley, 1998; and Misener, et al., (eds.), *Bioinformatics Methods and Protocols* (Methods in Molecular Biology, Vol. 132), Humana Press, 1999; all of the foregoing of which are incorporated herein by reference. In addition to identifying homologous sequences, the programs mentioned above typically provide an indication of the degree of homology. In some embodiments, two sequences are considered to be substantially homologous if at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or more of their corresponding residues are homologous over a relevant stretch of residues. In some embodiments, the relevant stretch is a complete sequence. In some embodiments, the relevant stretch is at least 10, at least 15, at least 20, at least 25, at least 30, at least 35, at least 40, at least 45, at least 50, at least 55, at least 60, at least 65, at least 70, at least 75, at least 80, at least 85, at least 90, at least 95, at least 100, at least 125, at least 150, at least 175, at least 200, at least 225, at least 250, at least 275, at least 300, at least 325, at least 350, at least 375, at least 400, at least 425, at least 450, at least 475, at least 500 or more residues.

Substantial identity: The phrase "substantial identity" is used herein to refer to a comparison between amino acid or nucleic acid sequences. As will be appreciated by those of ordinary skill in the art, two sequences are generally considered to be "substantially identical" if they contain identical residues in corresponding positions. As is well known in this art, amino acid or nucleic acid sequences may be compared using any of a variety of algorithms, including those available in commercial computer programs such as BLASTN for nucleotide sequences and BLASTP, gapped BLAST, and PSI-BLAST for amino acid sequences. Exemplary such programs are described in Altschul, et al., Basic local alignment search tool, *J. Mol. Biol.*, 215(3): 403-410, 1990; Altschul, et al., *Methods in Enzymology*; Altschul, et al., "Gapped BLAST and PSI-BLAST: a new generation of protein database search programs", *Nucleic Acids Res.* 25:3389-3402, 1997; Baxevanis, et al., *Bioinformatics: A Practical Guide to the Analysis of Genes and Proteins*, Wiley, 1998; and Misener, et al., (eds.), *Bioinformatics Methods and Protocols* (Methods in Molecular Biology, Vol. 132), Humana Press, 1999; all of the foregoing of which are incorporated herein by reference. In addition to identifying identical sequences, the programs mentioned above typically provide an indication of the degree of identity. In some embodiments, two sequences are considered to be substantially identical if at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or more of their corresponding residues are identical over a relevant stretch of residues. In some embodiments, the relevant stretch is a complete sequence. In some embodiments, the relevant stretch is at least 10, at least 15, at least 20, at least 25, at least 30, at least 35, at least 40, at least 45, at least 50, at least 55, at least 60, at least 65, at least 70, at least 75, at least 80, at least 85, at least 90, at least 95, at least 100, at least 125, at least 150, at least 175, at least 200, at least 225, at least 250, at least 275, at least 300, at least 325, at least 350, at least 375, at least 400, at least 425, at least 450, at least 475, at least 500 or more residues.

Therapeutic agent: As used herein, the phrase "therapeutic agent" refers to any agent that elicits a desired biological or pharmacological effect.

Treatment: As used herein, the term "treatment" refers to any method used to alleviate, delay onset, reduce severity or incidence, or yield prophylaxis of one or more symptoms or aspects of a disease, disorder, or condition. For the purposes of the present invention, treatment can be administered before, during, and/or after the onset of symptoms.

Umbrella topology: The phrase "umbrella topology" is used herein to refer to a 3-dimensional arrangement adopted by certain glycans and in particular by glycans on HA receptors. The present invention encompasses the recognition that binding to umbrella topology glycans is characteristic of HA proteins that mediate infection of human hosts. As illustrated in FIG. 6, the umbrella topology is typically adopted only by α2-6 sialylated glycans, and is typical of long (e.g., greater than tetrasaccharide) oligosaccharides. In some embodiments, umbrella-topology glycans are glycans exhibiting a three-dimensional structure substantially similar to the structure presented in FIG. 6 (right panel). In some embodiments, umbrella-topology glycans are glycans which contact HA polypeptides via the amino acid residues shown in FIG. 6 (right panel). In some embodiments, umbrella-topology glycans are glycans which are able to contact and/or specifically bind to the amino acid binding pocket shown in FIG. 6 (right panel). In some embodiments, glycan structural topology is classified based on parameter θ defined as angle between $C_2$ of Sia, $C_1$ of Gal, and $C_1$ of GlcNAc. Values of θ<100° represent cone-like topology adopted by α2-3 and short α2-6 glycans. Values of θ>110° represent umbrella-like topology, such as topology adopted by long α2-6 glycans (FIG. 6). An example of umbrella topology is given by φ angle of Neu5Acα2-6Gal linkage of around −60 (see, for example, FIG. 11). FIG. 9 presents certain representative (though not exhaustive) examples of glycans that can adopt an umbrella topology. The long α2-6 motifs presented in FIG. 9 includes Neu5Acα2-6 linked at the non-reducing end to a long chain (e.g., at least a trisaccharide) found as a part of biological N-linked glycans, O-linked glycans, and glycolipids. The boxed inset shows examples of the umbrella-topology long α2-6 glycan moieties that are found as a part of biological glycans that bind to high affinity with HA. In some embodiments, umbrella-topology glycans (e.g., at a site) comprise a greater proportion of long (e.g. multiple lactosamine units) α2-6 oligosaccharide branches than short α2-6 (e.g. single lactosamine) branches. In some embodiments, umbrella-topology glycans (e.g., at a site) comprise about 2-fold, about 3-fold, about 4-fold, about 5-fold, about 10-fold, about 20-fold, about 50-fold, or greater than about 50-fold more long α2-6 oligosaccharide branches than short α2-6 (e.g. single lactosamine) branches. In some embodiments, the unique characteristic of HA interactions with umbrella-topology glycans and/or glycan decoys is the HA contact with a glycan comprising sialic acid (SA) and/or SA analogs at the non-reducing end. In some embodiments, chain length of the oligosaccharide is at least a trisaccharide (excluding the SA or SA analog). In some embodiments, a combination of the numbered residues shown in the right-hand panel of FIG. 6 is involved in contacts with umbrella-like topology. In some embodiments, umbrella topology glycans are oligosaccharides of the following form:

Neu5Acα2-6Sug1-Sug2-Sug3 where:

(a) Neu5Ac α2-6 is typically (but not essentially) at the non-reducing end;

(b) Sug1:
(i) is a hexose (frequently Gal or Glc) or hexosamine (GlcNAc or GalNAc) in α or β configuration (frequently β- for N- and O-linked extension and α- in the case of GalNAcα- that is O-linked to glycoprotein);
(ii) no sugars other than Neu5Acα2-6 are attached to any of the non-reducing positions of Sug1 (except when Sug1 is GalNAcα- that is O-linked to the glycoprotein); and/or
(iii) non-sugar moieties such as sulfate, phosphate, guanidium, amine, N-acetyl, etc. can be attached to non-reducing positions (typically 6 position) of Sug1 (e.g., to improve contacts with HA);

(c) Sug2 and/or Sug3 is/are:
(i) hexose (frequently Gal or Glc) or hexosamine (GlcNAc or GalNAc) in a or β configuration (frequently β); and/or
(ii) sugars (such as Fuc) or non-sugar moieties such as sulfate, phosphate, guanidium, amine, N-acetyl, etc. can be attached to non-reducing positions of Sug2, Sug3, and/or Sug4;

(d) Linkage between any two sugars in the oligosaccharide apart from Neu5Acα2-6 linkage can be 1-2, 1-3, 1-4, and/or 1-6 (typically 1-3 or 1-4); and/or (e) Structure where Neu5Acα2-6 is linked GalNAcα that is O-linked to the glycoprotein and additional sugars are linked to the non-reducing end of GalNAcα for example
(i) Neu5Acα2-6(Neu5Acα2-3Galβ1-3)GalNAcα-
(ii) Neu5Acα2-6(Galβ1-3)GalNAcα-

Umbrella topology blocking agent (UTBA): As used herein, the term "umbrella topology blocking agent" refers to an agent which binds to an HA receptor having an umbrella topology glycan. In some embodiments, a UTBA binds to an HA receptor having an umbrella topology glycan found in human upper airways. A UBTA can bind to either an umbrella topology glycan and/or to a cone topology glycan. In some embodiments, a UTBA selectively binds to an umbrella topology glycan with 50, 100, 150, or 200% of its affinity for a cone topology glycan. In some embodiments a UTBA selectively binds to an umbrella topology glycan with 50-150% of its affinity for a cone topology glycan. In some embodiments, a UTBA binds to an umbrella topology glycan with about the same affinity as for a cone topology glycan. For example, in some embodiments, a UTBA binds an umbrella topology glycan (e.g., 6'SLN-LN) with about 50-200%, 50-150%, or about the same affinity to which it binds a cone topology glycan (e.g., 3'SLN-LN). In some embodiments, a UTBA selectively inhibits the binding of an influenza virus particle (e.g., a human or avian influenza virus) to the HA receptor based on the glycan topology of the receptor (e.g., umbrella or cone). In some embodiments, a UTBA is a polypeptide. In some such embodiments, a UTBA polypeptide has an amino acid sequence that is substantially identical or substantially homologous to that of a naturally-occurring polypeptide. In some embodiments, a UTBA polypeptide is an HA polypeptide. In some embodiments, a UTBA polypeptide is a naturally-occurring HA polypeptide, or a fragment thereof. In some embodiments, a UTBA polypeptide has an amino acid sequence that is not related to that of an HA polypeptide. In some embodiments, a UTBA polypeptide is an antibody or fragment thereof. In some embodiments, a UTBA polypeptide is a lectin (e.g., SNA-1). In some embodiments, a UTBA is not a polypeptide. In some embodiments, a UTBA is a small molecule. In some embodiments, a UTBA is a nucleic acid.

Umbrella topology glycan mimic: An "umbrella topology glycan mimic" is an agent, other than an umbrella topology glycan, that binds to binding agents as described herein. In some embodiments, umbrella topology glycan mimics are agents that bind to HA polypeptides. In some such embodiments, umbrella topology glycan mimics are agents that interact with HA polypeptide residues selected from the group consisting of residues 95, 98, 128, 130, 131, 132, 133, 135, 136, 137, 138, 145, 153, 155, 156, 158, 159, 160, 183, 186, 187, 188, 189, 190, 192, 193, 194, 195, 196, 219, 221, 222, 224, 225, 226, 227, 228, and combinations thereof. In some such embodiments, umbrella topology glycan mimics are agents that interact with HA polypeptide residues selected from the group consisting of residues 130, 131, 132, 133, 135, 137, 155, 188, 192, 193, 221, 226, 227, 228, and combinations thereof. In some such embodiments, umbrella topology glycan mimics are agents that interact with HA polypeptide residues selected from the group consisting of residues 160, 192, 193, and combinations thereof. Note that amino acid positions stated above are based on H3 HA numbering. In some embodiments, an HA topology glycan mimic is an agent that competes with umbrella topology glycans for interaction with an HA polypeptide.

Umbrella topology specific blocking agent (UTSBA): As used herein, the term "umbrella topology specific blocking agent" refers to an agent which binds to an HA receptor having an umbrella topology glycan found in human upper airways. A UTSBA selectively binds an umbrella topology glycan HA. For example, a UTSBA binds an umbrella topology glycan (e.g., 6'SLN-LN) with about at least 2, at least 4, at least 5, or at least 10 times greater affinity than it binds to a cone topology glycan (e.g., 3'SLN-LN). Typically, the affinity of a UTSBA for an umbrella topology glycan is greater than 1 nM. Typically the affinity of a UTSBA for a cone topology glycan is less is at least within 2 to 3 orders of magnitude of the binding affinity of umbrella topology glycans to human adapted HAs such as SC18, Mos99, Tx91, etc. and α2-6 binding plant lectins such as SNA-I. The binding affinity of UTSBA as measured by the dose-dependent direct binding assay (FIGS. 19 and 20) would typically be at least 1 nM. Typically the affinity of a UTSBA for a cone topology glycan is at most 1 to 3 orders of magnitude less than the binding affinity of cone topology glycans to avian HAs such as Viet0405, Av18, etc. In some embodiments, a UTSBA selectively inhibits binding of an influenza virus particle (e.g., a human or avian influenza virus) to the HA receptor (e.g., an H1, H2 or H3 or a human-adapted H5, H7 or H9) based on glycan topology (e.g., umbrella or cone). In some embodiments, a UTSBA is a polypeptide. In some such embodiments, a UTSBA polypeptide has an amino acid sequence that is that is substantially identical or substantially homologous to that of a naturally-occurring polypeptide. In some embodiments, a UTSBA polypeptide is an HA polypeptide. In some embodiments, a UTSBA polypeptide is a naturally-occurring HA polypeptide, or a fragment thereof. In some embodiments, a UTSBA polypeptide has an amino acid sequence that is not related to that of an HA polypeptide. In some embodiments, a UTSBA polypeptide is an antibody or fragment thereof. In some embodiments, a UTSBA polypeptide is a lectin (e.g., SNA-1). In some embodiments, a UTSBA is not a polypeptide. In some embodiments, a UTSBA is a small molecule. In some embodiments, a UTSBA is a nucleic acid.

Vaccination: As used herein, the term "vaccination" refers to the administration of a composition intended to generate an immune response, for example to a disease-causing agent. For the purposes of the present invention, vaccination can be administered before, during, and/or after exposure to a disease-causing agent, and in some embodiments, before, during, and/or shortly after exposure to the agent. In some embodiments, vaccination includes multiple administrations, appropriately spaced in time, of a vaccinating composition.

Variant: As used herein, the term "variant" is a relative term that describes the relationship between a particular polypeptide (e.g., HA polypeptide) of interest and a "parent" polypeptide to which its sequence is being compared. A polypeptide of interest is considered to be a "variant" of a parent polypeptide if the polypeptide of interest has an amino acid sequence that is identical to that of the parent but for a small number of sequence alterations at particular positions. Typically, fewer than 20%, 15%, 10%, 9%, 8%, 7%, 6%, 5%, 4%, 3%, 2% of the residues in the variant are substituted as compared with the parent. In some embodiments, a variant has 10, 9, 8, 7, 6, 5, 4, 3, 2, or 1 substituted residue as compared with a parent. Often, a variant has a very small number (e.g., fewer than 5, 4, 3, 2, or 1) number of substituted functional residues (i.e., residues that participate in a particular biological activity). Furthermore, a variant typically has not more than 5, 4, 3, 2, or 1 additions or deletions, and often has no additions or deletions, as compared with the parent. Moreover, any additions or deletions are typically fewer than about 25, about 20, about 19, about 18, about 17, about 16, about 15, about 14, about 13, about 10, about 9, about 8, about 7, about 6, and commonly are fewer than about 5, about 4, about 3, or about 2 residues. In some embodiments, the parent polypeptide is one found in nature. For example, a parent HA polypeptide may be one found in a natural (e.g., wild type) isolate of an influenza virus (e.g., a wild type HA).

Vector: As used herein, "vector" refers to a nucleic acid molecule capable of transporting another nucleic acid to which it has been linked. In some embodiment, vectors are capable of extra-chromosomal replication and/or expression of nucleic acids to which they are linked in a host cell such as a eukaryotic or prokaryotic cell. Vectors capable of directing the expression of operatively linked genes are referred to herein as "expression vectors."

Wild type: As is understood in the art, the phrase "wild type" generally refers to a normal form of a protein or nucleic acid, as is found in nature. For example, wild type HA polypeptides are found in natural isolates of influenza virus. A variety of different wild type HA sequences can be found in the NCBI influenza virus sequence database, available through the world wide web at ncbi.nlm.nih.gov/genomes/FLU/FLU.

DETAILED DESCRIPTION OF CERTAIN EMBODIMENTS

The present invention provides binding agents (e.g., HA polypeptides, HA polypeptide variants, LSBAs, UTBAs, UTSBAs, etc.) that bind to umbrella topology glycans. In some embodiments, the present invention provides binding agents that bind to umbrella topology glycans found on HA receptors of a particular target species. For example, in some embodiments, the present invention provides binding agents that bind to umbrella topology glycans found on human HA receptors, e.g., HA receptors found on human epithelial cells, and particularly binding agents that bind to umbrella topology glycans found on human HA receptors in the upper respiratory tract.

The present invention provides binding agents that bind to HA receptors found on cells in the human upper respiratory tract, and in particular provides binding agents that binds to such receptors (and/or to their glycans, particularly to their umbrella glycans) with a designated affinity and/or specificity.

In some embodiments, binding agents in accordance with the present invention are or comprise HA polypeptide sequences. In some embodiments, binding agents in accordance with the present invention comprise an HA polypeptide sequence which differs from a parent naturally-occurring HA polypeptide sequence at one or more of residues selected from the group consisting of residues 130, 131, 132, 133, 135, 137, 155, 188, 192, 193, 221, 226, 227, 228, and combinations thereof. In some embodiments, binding agents in accordance with the present invention comprise an HA polypeptide sequence which differs from a parent naturally-occurring HA polypeptide sequence at one or more of residues selected from the group consisting of residues 160, 192, 193, and combinations thereof.

The present invention encompasses the recognition that gaining an ability to bind umbrella topology glycans (e.g., long α2-6 sialylated glycans), and particularly an ability to bind with high affinity, may confer upon an HA polypeptide variant the ability to infect humans (where its parent HA polypeptide cannot). Without wishing to be bound by any particular theory, the present inventors propose that binding to umbrella topology glycans may be paramount, and in particular that loss of binding to other glycan types may not be required.

The present invention further provides various reagents and methods associated with binding agents in accordance with the invention (e.g., HA polypeptides, HA polypeptide variants, UTBAs, UTSBAs, etc.) including, for example, systems for identifying them, strategies for preparing them, antibodies that bind to them, and various diagnostic and therapeutic methods relating to them. Further description of certain embodiments of these aspects, and others, of the present invention, is presented below.

Hemagglutinin (HA)

Influenza viruses are RNA viruses which are characterized by a lipid membrane envelope containing two glycoproteins, hemagglutinin (HA) and neuraminidase (NA), embedded in the membrane of the virus particular. There are 16 known HA subtypes and 9 NA subtypes, and different influenza strains are named based on the number of the strain's HA and NA subtypes. Based on comparisons of amino acid sequence identity and of crystal structures, the HA subtypes have been divided into two main groups and four smaller clades. The different HA subtypes do not necessarily share strong amino acid sequence identity, but the overall 3D structures of the different HA subtypes are similar to one another, with several subtle differences that can be used for classification purposes. For example, the particular orientation of the membrane-distal subdomains in relation to a central α-helix is one structural characteristic commonly used to determine HA subtype (Russell et al., 2004, *Virology*, 325:287; incorporated herein by reference).

HA exists in the membrane as a homotrimer of one of 16 subtypes, termed H1-H16. Only three of these subtypes (H1, H2, and H3) have thus far become adapted for human infection. One reported characteristic of HAs that have adapted to infect humans (e.g., of HAs from the pandemic H1N1 (1918) and H3N2 (1967-68) influenza subtypes) is their ability to preferentially bind to α2-6 sialylated glycans in comparison with their avian progenitors that preferentially bind to α2-3 sialylated glycans (Skehel & Wiley, 2000, *Annu Rev Biochem*, 69:531; Rogers, & Paulson, 1983, *Virology*, 127:361; Rogers et al., 1983, *Nature*, 304:76; Sauter et al., 1992, *Biochemistry*, 31:9609; Connor et al., 1994, *Virology*, 205:17; Tumpey et al., 2005, *Science*, 310: 77; all of which are incorporated herein by reference). The present invention, however, encompasses the recognition that ability to infect human hosts correlates less with binding to glycans of a particular linkage, and more with binding to glycans of a particular topology. Thus, the present invention demonstrates that HAs that mediate infection of humans bind to umbrella topology glycans, often showing preference for umbrella topology glycans over cone topology glycans (even though cone-topology glycans may be α2-6 sialylated glycans).

Several crystal structures of HAs from H1 (human and swine), H3 (avian) and H5 (avian) subtypes bound to sialylated oligosaccharides (of both α2-3 and α2-6 linkages) are available and provide molecular insights into the specific amino acids that are involved in distinct interactions of the HAs with these glycans (Eisen et al., 1997, *Virology*, 232:19; Ha et al., 2001, *Proc Natl Acad Sci USA*, 98:11181; Ha et al., 2003, *Virology*, 309:209; Gamblin et al., 2004, *Science*, 303:1838; Stevens et al., 2004, *Science*, 303:1866; Russell et al., 2006, *Glycoconj J* 23:85; Stevens et al., 2006, *Science*, 312:404; all of which are incorporated herein by reference).

For example, the crystal structures of H5 (A/duck/Singapore/3/97) alone or bound to an α2-3 or an α2-6 sialylated oligosaccharide identifies certain amino acids that interact directly with bound glycans, and also amino acids that are one or more degree of separation removed (Stevens et al., 2001, *Proc Natl Acad Sci USA* 98:11181; incorporated herein by reference). In some cases, conformation of these residues is different in bound versus unbound states. For instance, Glu190, Lys193, and Gln226 all participate in direct-binding interactions and have different conformations in the bound versus the unbound state. The conformation of Asn186, which is proximal to Glu190, is also significantly different in the bound versus the unbound state.

Binding Agents

As noted above, the present invention encompasses the finding that binding to umbrella topology glycans correlates with ability to mediate infection of particular hosts, including for example, humans. Accordingly, the present invention provides binding agents (e.g., HA polypeptides, HA polypeptide variants, LSBAs, UTBAs, UTSBAs, etc.) that bind to umbrella glycans (and/or to umbrella topology glycan mimics). In some embodiments, binding agents in accordance with the invention bind to umbrella glycans (and/or to umbrella topology glycan mimics) with high affinity. In some embodiments, binding agents in accordance with the invention bind to a plurality of different umbrella topology glycans, often with high affinity and/or specificity.

In some embodiments, binding agents in accordance with the invention bind to umbrella topology glycans (e.g., long α2-6 sialylated glycans such as, for example, Neu5Acα2-6Galβ1-4GlcNAcβ1-3Galβ1-4GlcNAc-) with high affinity. For example, in some embodiments, binding agents in accordance with the invention bind to umbrella topology glycans with an affinity comparable to that observed for a wild type HA that mediates infection of a humans (e.g., H1N1 HA or H3N2 HA). In some embodiments, binding agents in accordance with the invention bind to umbrella glycans with an affinity that is at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 96%, at least 97%, at least 98%, at least 99%, or 100% of that observed under comparable conditions for a wild type HA that mediates infection of humans. In some embodiments, binding agents in accordance with the invention bind to umbrella glycans with an affinity that is greater than that observed under comparable conditions for a wild type HA that mediates infection of humans.

In some embodiments, binding affinity of binding agents in accordance with the invention is assessed over a range of concentrations. Such a strategy provides significantly more information, particularly in multivalent binding assays, than do single-concentration analyses. In some embodiments, for example, binding affinities of binding agents in accordance with the invention are assessed over concentrations ranging over at least 2, at least 3, at least 4, at least 5, at least 6, at least 7, at least 8, at least 9, at least 10 or more fold.

In some embodiments, binding agents in accordance with the invention show high affinity if they show a saturating signal in a multivalent glycan array binding assay such as those described herein. In some embodiments, binding agents in accordance with the invention show high affinity if they show a signal above about 400000 or more (e.g., above about 500000, about 600000, about 700000, about 800000, etc.) in such studies. In some embodiments, binding agents as described herein show saturating binding to umbrella glycans over a concentration range of at least 2 fold, at least 3 fold, at least 4 fold, at least 5 fold or more, and in some embodiments over a concentration range as large as 10 fold or more.

Furthermore, in some embodiments, binding agents in accordance with the invention bind to umbrella topology glycans (and/or to umbrella topology glycan mimics) more strongly than they bind to cone topology glycans. In some embodiments, binding agents in accordance with the invention show a relative affinity for umbrella glycans vs. cone glycans that is about 10, about 9, about 8, about 7, about 6, about 5, about 4, about 3, or about 2.

In some embodiments, binding agents in accordance with the invention bind to α2-6 sialylated glycans; in some embodiments, binding agents in accordance with the invention bind preferentially to α2-6 sialylated glycans. In some embodiments, binding agents in accordance with the invention bind to a plurality of different α2-6 sialylated glycans. In some embodiments, binding agents in accordance with the invention are not able to bind to α2-3 sialylated glycans, and in some embodiments binding agents in accordance with the invention are able to bind to α2-3 sialylated glycans.

In some embodiments, binding agents in accordance with the invention bind to receptors found on human upper respiratory epithelial cells. In some embodiments, binding agents in accordance with the invention bind to HA receptors in the bronchus and/or trachea. In some embodiments, binding agents in accordance with the invention are not able to bind receptors in the deep lung, and in some embodiments, binding agents in accordance with the invention are able to bind receptors in the deep lung.

In some embodiments, binding agents in accordance with the invention bind to at least about 10%, about 15%, about 20%, about 25%, about 30% about 35%, about 40%, about 45%, about 50%, about 55%, about 60%, about 65%, about 70%, about 75%, about 80%, about 85%, about 90%, about 95%, or more of the glycans found on HA receptors in human upper respiratory tract tissues (e.g., epithelial cells).

In some embodiments, binding agents in accordance with the invention bind to one or more of the glycans illustrated in FIG. 9. In some embodiments, binding agents in accordance with the invention bind to multiple glycans illustrated in FIG. 9. In some embodiments, binding agents in accordance with the invention bind with high affinity and/or specificity to glycans illustrated in FIG. 9. In some embodiments, binding agents in accordance with the invention bind to glycans illustrated in FIG. 9 preferentially as compared with their binding to glycans illustrated in FIG. 8. In some embodiments, binding agents in accordance with the invention bind to an oligosaccharide of the following form:

Neu5Acα2-6Sug1-Sug2-Sug3 where:

1. Neu5Ac α2-6 is always or almost always at the non-reducing end;
2. Sug1:
   a. is a hexose (frequently Gal or Glc) or hexosamine (GlcNAc or GalNAc) in α or β configuration (frequently β- for N- and O-linked extension and α- in the case of GalNAcα- that is O-linked to glycoprotein);
   b. no sugars other than Neu5Acα2-6 should be attached to any of the non-reducing positions of Sug1 (except when Sug1 is GalNAcα- that is O-linked to the glycoprotein); and/or
   c. non-sugar moieties such as sulfate, phosphate, guanidium, amine, N-acetyl, etc. can be attached to non-reducing positions (typically 6 position) of Sug1 to improve contacts with HA;
3. Sug2 and/or Sug3:
   a. hexose (frequently Gal or Glc) or hexosamine (GlcNAc or GalNAc) in α or β configuration (frequently β); and/or
   b. sugars (such as Fuc) or non-sugar moieties such as sulfate, phosphate, guanidium, amine, N-acetyl, etc. can be attached to non-reducing positions of Sug2, Sug3, and/or Sug4;
4. Linkage between any two sugars in the oligosaccharide apart from Neu5Acα2-6 linkage can be 1-2, 1-3, 1-4, and/or 1-6 (typically 1-3 or 1-4); and/or
5. Structure where Neu5Acα2-6 is linked GalNAcα that is O-linked to the glycoprotein and additional sugars are linked to the non-reducing end of GalNAcα for example
   i. Neu5Acα2-6(Neu5Acα2-3Galβ1-3)GalNAcα-
   ii. Neu5Acα2-6(Galβ1-3)GalNAcα-

The present invention provides binding agents with designated binding specificity, and also provides binding agents with designated binding characteristics with respect to umbrella glycans.

Certain particular binding agents provided by the present invention are described in more detail below.

HA Polypeptides

In some embodiments, binding agents in accordance with the invention are HA polypeptides. For example, the present invention provides isolated HA polypeptides with designated binding specificity, and also provides engineered HA polypeptides with designated binding characteristics with respect to umbrella glycans.

In some embodiments, provided HA polypeptides with designated binding characteristics are H1 polypeptides. In some embodiments, HA polypeptides in accordance with the invention with designated binding characteristics are H2 polypeptides. In some embodiments, HA polypeptides in accordance with the invention with designated binding characteristics are H3 polypeptides. In some embodiments, HA polypeptides in accordance with the invention with designated binding characteristics are H4 polypeptides. In some embodiments, HA polypeptides in accordance with the invention with designated binding characteristics are H5 polypeptides. In some embodiments, HA polypeptides in accordance with the invention with designated binding characteristics are H6 polypeptides. In some embodiments, HA polypeptides in accordance with the invention with designated binding characteristics are H7 polypeptides. In some embodiments, HA polypeptides in accordance with the invention with designated binding characteristics are H8 polypeptides. In some embodiments, HA polypeptides in accordance with the invention with designated binding characteristics are H9 polypeptides. In some embodiments, HA polypeptides in accordance with the invention with designated binding characteristics are H10 polypeptides. In some embodiments, HA polypeptides in accordance with the invention with designated binding characteristics are H11 polypeptides. In some embodiments, HA polypeptides in accordance with the invention with designated binding characteristics are H12 polypeptides. In some embodiments, HA polypeptides in accordance with the invention with designated binding characteristics are H13 polypeptides. In some embodiments, HA polypeptides in accordance with the invention with designated binding characteristics are H14 polypeptides. In some embodiments, HA polypeptides in accordance with the invention with designated binding characteristics are H15 polypeptides. In some embodiments, HA polypeptides in accordance with the invention with designated binding characteristics are H16 polypeptides.

In some embodiments, HA polypeptides in accordance with the invention do not include the H1 protein from any of the strains: A/South Carolina/i/1918; A/Puerto Rico/8/1934; A/Taiwan/1/1986; A/Texas/36/1991; A/Beijing/262/1995; A/Johannesburg/92/1996; A/New Caledonia/20/1999; A/Solomon Islands/3/2006.

In some embodiments, HA polypeptides in accordance with the invention are not the H2 protein from any of the strains of the Asian flu epidemic of 1957-58). In some embodiments, HA polypeptides in accordance with the invention do not include the H2 protein from any of the strains: A/Japan/305+/1957; A/Singapore/i/1957; A/Taiwan/1/1964; A/Taiwan/1/1967.

In some embodiments, HA polypeptides in accordance with the invention do not include the H3 protein from any of the strains: A/Aichi/2/1968; A/Philippines/2/1982; A/Mississippi/i/1985; A/Leningrad/360/1986; A/Sichuan/2/1987; A/Shanghai/11/1987; A/Beijing/353/1989; A/Shandong/9/1993; A/Johannesburg/33/1994; A/Nanchang/813/1995; A/Sydney/5/1997; A/Moscow/10/1999; A/Panama/2007/1999; A/Wyoming/3/2003; A/Oklahoma/323/2003; A/California/7/2004; A/Wisconsin/65/2005.

Variant HA Polypeptides

In some embodiments, a provided HA polypeptide is a variant of a parent HA polypeptide in that its amino acid sequence is identical to that of the parent HA but for a small number of particular sequence alterations. In some embodiments, the parent HA is an HA polypeptide found in a natural isolate of an influenza virus (e.g., a wild type HA polypeptide).

In some embodiments, HA polypeptide variants in accordance with the invention have different glycan binding characteristics than their corresponding parent HA polypeptides. In some embodiments, HA variant polypeptides in accordance with the invention have greater affinity and/or specificity for umbrella glycans (e.g., as compared with for cone glycans) than do their cognate parent HA polypeptides. In some embodiments, such HA polypeptide variants are engineered variants.

In some embodiments, HA variant polypeptides in accordance with the invention have greater affinity and/or specificity for umbrella glycans as compared with their cognate parent HA polypeptides. In some embodiments, HA variant polypeptides in accordance with the invention have reduced affinity and/or specificity for cone topology glycans as compared with their cognate parent HA polypeptides. In some embodiments, HA variant polypeptides in accordance with the invention have greater affinity and/or specificity for umbrella glycans and reduced affinity and/or specificity for cone topology glycans as compared with their cognate parent HA polypeptides.

In some embodiments, HA variant polypeptides in accordance with the invention have greater affinity and/or specificity for $\alpha 2$-6 glycans as compared with their cognate parent HA polypeptides. In some embodiments, HA variant polypeptides in accordance with the invention have reduced affinity and/or specificity for $\alpha 2$-3 glycans as compared with their cognate parent HA polypeptides. In some embodiments, HA variant polypeptides in accordance with the invention have greater affinity and/or specificity for $\alpha 2$-6 and $\alpha 2$-3 glycans as compared with their cognate parent HA polypeptides. In some embodiments, HA variant polypeptides in accordance with the invention have greater affinity and/or specificity for $\alpha 2$-6 glycans and reduced affinity and/or specificity for $\alpha 2$-3 glycans as compared with their cognate parent HA polypeptides.

In some embodiments, HA variant polypeptides in accordance with the invention have greater affinity and/or specificity for umbrella topology glycans and $\alpha 2$-3 glycans as compared with their cognate parent HA polypeptides. In some embodiments, HA variant polypeptides in accordance with the invention have greater affinity and/or specificity for umbrella topology glycans and reduced affinity and/or specificity for $\alpha 2$-3 glycans as compared with their cognate parent HA polypeptides.

In some embodiments, HA variant polypeptides in accordance with the invention have greater affinity and/or specificity for $\alpha 2$-6 glycans and cone topology glycans as compared with their cognate parent HA polypeptides. In some embodiments, HA variant polypeptides in accordance with the invention have greater affinity and/or specificity for $\alpha 2$-6 glycans and reduced affinity and/or specificity for cone topology glycans as compared with their cognate parent HA polypeptides.

In some embodiments, HA polypeptide variants in accordance with the invention contain one or more sequence alterations that are consistent with HA sequences found in a different HA subtype. To give but one particular example, in some embodiments, an H5 HA polypeptide variant in accordance with the invention contains one or more sequence alterations which make the H5 HA polypeptide variant more closely resemble an H2 HA polypeptide. To give another particular example, in some embodiments, an H5 HA polypeptide variant in accordance with the invention contains one or more sequence alterations which make the H5 HA polypeptide variant more closely resemble an H1 HA polypeptide.

The present invention particularly encompasses the recognition that HA polypeptide variants (e.g., H1, H2, H3, H4, H5, H6, H7, H8, H9, H10, H11, H12, H13, H14, H15, or H16 HA polypeptide variants) with altered glycosylation can show 2-fold, 3-fold, 4-fold, 5-fold, 10-fold, 20-fold, 50-fold, 100-fold, 1000-fold, 10,000-fold, or greater affinity to human HA receptors as compared with a reference HA polypeptide. The present invention also particularly encompasses the recognition that HA polypeptide variants (e.g., H1, H2, H3, H4, H5, H6, H7, H8, H9, H10, H11, H12, H13, H14, H15, or H16 HA polypeptide variants) with alterations in the HA loop region, can show 2-fold, 3-fold, 4-fold, 5-fold, 10-fold, 20-fold, 50-fold, 100-fold, 1000-fold, 10,000-fold, or greater affinity to human HA receptors as compared with a reference HA polypeptide (e.g., an HA polypeptide of any of SEQ ID NOs: 43-55).

The present invention particularly encompasses the recognition that HA polypeptide variants (e.g., H1, H2, H3, H4, H5, H6, H7, H8, H9, H10, H11, H12, H13, H14, H15, or H16 HA polypeptide variants) with altered glycosylation can show 2-fold, 3-fold, 4-fold, 5-fold, 10-fold, 20-fold, 50-fold, 100-fold, 1000-fold, 10,000-fold, or greater specificity for human HA receptors as compared with a reference HA polypeptide. The present invention also particularly encompasses the recognition that HA polypeptide variants (e.g., H1, H2, H3, H4, H5, H6, H7, H8, H9, H10, H11, H12, H13, H14, H15, or H16 HA polypeptide variants) with alterations in the HA loop region, can show 2-fold, 3-fold, 4-fold, 5-fold, 10-fold, 20-fold, 50-fold, 100-fold, 1000-fold, 10,000-fold, or greater specificity for human HA receptors as compared with a reference HA polypeptide (e.g., an HA polypeptide of any of SEQ ID NOs: 43-55).

In some embodiments, the reference HA polypeptide is the HA from A/South Carolina/1/18 (H1N1) (SEQ ID NO: 43). In some embodiments, the reference HA polypeptide is the HA from A/Brisbane/59/07 (SEQ ID NO: 44). In some embodiments, the reference HA polypeptide is the HA from A/California/04/09 (SEQ ID NO: 45). In some embodiments, the reference HA polypeptide is the HA from A/Albany/6/58 (H2N2) (SEQ ID NO: 46). In some embodiments, the reference HA polypeptide is the HA from A/Aichi/1/68 (SEQ ID NO: 47). In some embodiments, the reference HA polypeptide is the HA from A/Moscow/10/99 (SEQ ID NO: 48). In some embodiments, the reference HA polypeptide is the HA from A/Perth/16/09 (SEQ ID NO: 49). In some embodiments, the reference HA polypeptide is the HA from A/Vietnam/1203/04 (SEQ ID NO: 50). In some embodiments, the reference HA polypeptide is the HA from A/Egypt/2786-NAMRU3/06 (SEQ ID NO: 51). In some embodiments, the reference HA polypeptide is the HA from A/New York/107/03 (SEQ ID NO: 52). In some embodiments, the reference HA polypeptide is the HA from A/Hongkong/486/97 (SEQ ID NO: 53). In some embodiments, the reference HA polypeptide is the HA from A/Hongkong/213/03 (SEQ ID NO: 54). In some embodiments, the reference HA polypeptide is the HA from A/Indonesia/5/05 (SEQ ID NO: 55).

In some embodiments, HA polypeptide variants with altered glycan binding characteristics have one or more sequence alternations in residues within or affecting the glycan binding site. In some embodiments, such substitutions are of amino acids that interact directly with bound glycan; in some embodiments, such substitutions are of amino acids that are one degree of separation removed from those that interact with bound glycan, in that the one degree of separation removed-amino acids either (1) interact with the direct-binding amino acids; (2) otherwise affect the ability of the direct-binding amino acids to interact with glycan, but do not interact directly with glycan themselves; or (3) otherwise affect the ability of the direct-binding amino acids to interact with glycan, and also interact directly with glycan themselves. HA polypeptide variants in accordance with the invention contain substitutions of one or more direct-binding amino acids, one or more first degree of separation-amino acids, one or more second degree of separation-amino acids, or any combination of these. In some embodiments, HA polypeptide variants in accordance with the invention may contain substitutions of one or more amino acids with even higher degrees of separation.

Figure 7:
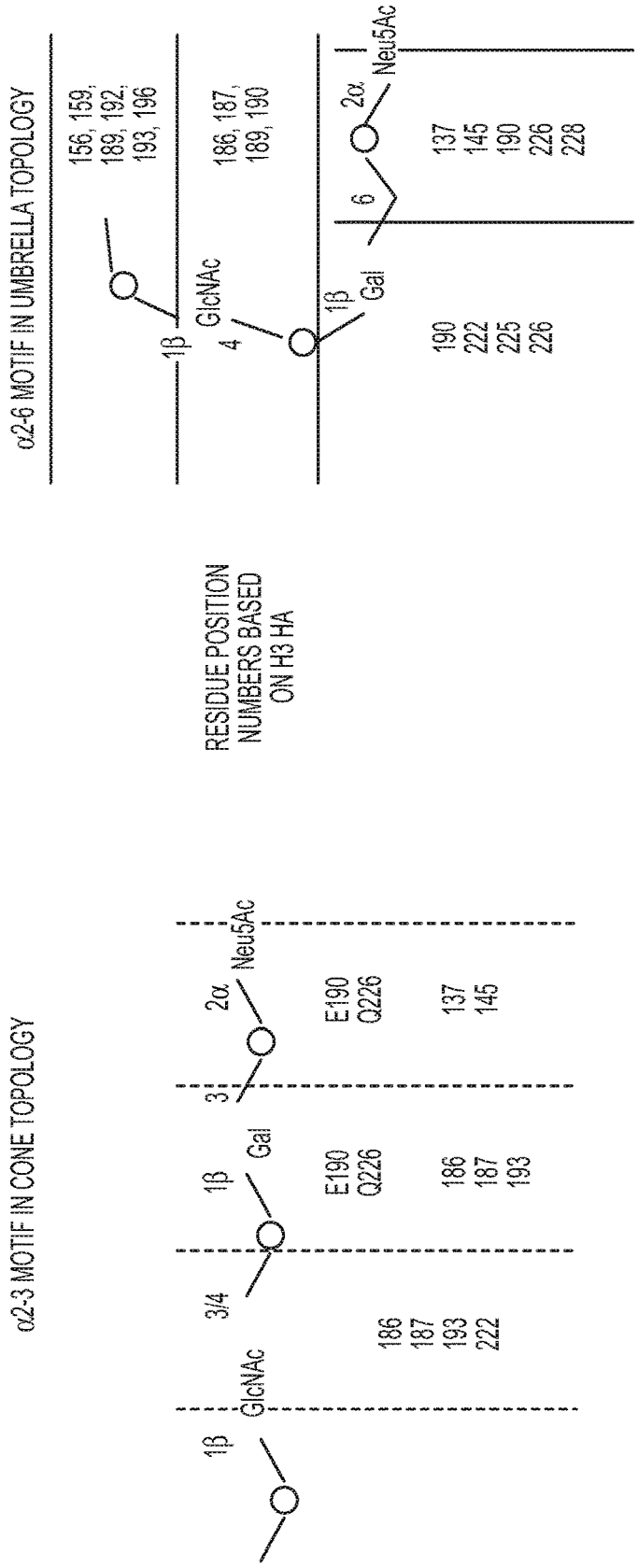
FIG. 7. Interactions of HA residues with cone vs. umbrella glycan topologies. Analysis of HA-glycan co-crystals reveals that the position of Neu5Ac relative to the HA binding site is almost invariant. Contacts with Neu5Ac involve highly conserved residues such as F98, S/T136, W153, H183 and L/I194. Contacts with other sugars involve different residues, depending on whether the sugar linkage is α2-3 or α2-6 and whether the glycan topology is cone or umbrella. For example, in the cone topology, the primary contacts are with Neu5Ac and with Gal sugars. E190 and Q226 play particularly important roles in this binding. This Figure also illustrates other positions (e.g., 137, 145, 186, 187, 193, 222) that can participate in binding to cone structures. In some cases, different residues can make different contacts with different glycan structures. The type of amino acid in these positions can influence ability of an HA polypeptide to bind to receptors with different modification and/or branching patterns in the glycan structures. In the umbrella topology, contacts are made with sugars beyond Neu5Ac and Gal. This Figure illustrates residues (e.g., 137, 145, 156, 159, 186, 187, 189, 190, 192, 193, 196, 222, 225, 226) that can participate in binding to umbrella structures. In some cases, different residues can make different contacts with different glycan structures. The type of amino acid in these positions can influence ability of an HA polypeptide to bind to receptors with different modification and/or branching patterns in the glycan structures. In some embodiments, a D residue at position 190 and/or a D residue at position 225 contribute(s) to binding to umbrella topologies.

In some embodiments, HA polypeptide variants with altered glycan binding characteristics have sequence alterations in residues that make contact with sugars beyond Neu5Ac and Gal (see, for example, FIG. 7).

In some embodiments, HA polypeptide variants have at least one amino acid substitution, as compared with a wild type parent HA. In some embodiments, HA polypeptide variants in accordance with the invention have at least two, three, four, five or more amino acid substitutions as compared with a cognate wild type parent HA; in some embodiments HA polypeptide variants in accordance with the invention have two, three, or four amino acid substitutions. In some embodiments, all such amino acid substitutions are located within the glycan binding site.

In some embodiments, HA polypeptide variants in accordance with the invention contain one or more amino acid substitutions as described in any of U.S. Patent Publication Number 2009/0269342 and 2010/0004195, and in U.S. patent application Ser. No. 12/829,931, filed Jul. 2, 2010, entitled "COMPOSITIONS AND METHODS FOR DIAGNOSING AND/OR TREATING INFLUENZA INFECTION" (all of which are incorporated herein by reference).

In some embodiments, HA polypeptide variants have sequence substitutions at positions corresponding to one or more of residues 95, 98, 128, 130, 131, 132, 133, 135, 136, 137, 138, 145, 153, 155, 156, 158, 159, 160, 183, 186, 187, 188, 189, 190, 192, 193, 194, 195, 196, 219, 221, 222, 224, 225, 226, 227, and 228. In some embodiments, HA polypeptide variants, particularly H5 polypeptide variants, have one or more amino acid substitutions relative to a wild type parent HA (e.g., H5) at residues selected from the group consisting of residues 95, 98, 128, 130, 131, 132, 133, 135, 136, 137, 138, 145, 153, 155, 156, 158, 159, 160, 183, 186, 187, 188, 189, 190, 192, 193, 194, 195, 196, 219, 221, 222, 224, 225, 226, 227, and 228. In some embodiments, HA polypeptide variants, particularly H5 polypeptide variants, have one or more amino acid substitutions relative to a wild type parent HA (e.g., H5) at any 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, or 37 residues selected from the group consisting of residues 95, 98, 128, 130, 131, 132, 133, 135, 136, 137, 138, 145, 153, 155, 156, 158, 159, 160, 183, 186, 187, 188, 189, 190, 192, 193, 194, 195, 196, 219, 221, 222, 224, 225, 226, 227, and 228.

In some embodiments, HA polypeptide variants (e.g., H5 HA polypeptide variants) have sequence substitutions that reduce or abolish glycosylation at a site corresponding to amino acid position 158. In some embodiments, HA polypeptide variants (e.g., H5 HA polypeptide variants) have sequence substitutions that affect and/or alter the identity and/or structure of the glycan linked to a site corresponding to amino acid position 158. In some embodiments, such a sequence substitution is a mutation at a site corresponding to position 158, e.g., Asn158Xaa, wherein Xaa is any amino acid other than Asn. In some embodiments, such a sequence substitution is a mutation at a site corresponding to position 160, e.g., Thr160Xaa, wherein Xaa is any amino acid other than Asn. In some embodiments, such a sequence substitution comprises the mutation Thr160Ala. In some embodiments, a sequence substitution that reduces, abolishes, affects, or alters glycosylation at a site corresponding to amino acid position 158 can make a non-H2 HA polypeptide (e.g., an H5 HA polypeptide) more closely resemble (e.g., both structurally and functionally) an H2 HA polypeptide. In some embodiments, a mutation at a site corresponding to position 160 (e.g., Thr160Xaa, such as Thr160Ala) can make a non-H2 HA polypeptide (e.g., an H5 HA polypeptide) more closely resemble (e.g., both structurally and functionally) an H2 HA polypeptide.

In some embodiments, HA polypeptide variants (e.g., H5 HA polypeptide variants) have sequence substitutions relative to a wild type parent HA (e.g., H5 HA) at positions corresponding to one or more of residues 226, 228, and 160. In some embodiments, HA polypeptide variants (e.g., H5 HA polypeptide variants) have sequence substitutions relative to a wild type parent HA (e.g., H5 HA) at positions corresponding to residues 226, 228, and 160. In some embodiments, HA polypeptide variants (e.g., H5 HA polypeptide variants) have sequence substitutions relative to a wild type parent HA (e.g., H5 HA) at positions corresponding to residues 226 and 160. In some embodiments, HA polypeptide variants (e.g., H5 HA polypeptide variants) have sequence substitutions relative to a wild type parent HA (e.g., H5 HA) at positions corresponding to residues 228 and 160. In some embodiments, HA polypeptide variants (e.g., H5 HA polypeptide variants) have sequence substitutions relative to a wild type parent HA (e.g., H5 HA) at positions corresponding to residues 226 and 228.

In some embodiments, HA polypeptide variants (e.g., H5 HA polypeptide variants) have sequence substitutions relative to a wild type parent HA (e.g., H5 HA) at positions corresponding to one or more of residues 226, 228, and 158. In some embodiments, HA polypeptide variants (e.g., H5 HA polypeptide variants) have sequence substitutions relative to a wild type parent HA (e.g., H5 HA) at positions corresponding to residues 226, 228, and 158. In some embodiments, HA polypeptide variants (e.g., H5 HA polypeptide variants) have sequence substitutions relative to a wild type parent HA (e.g., H5 HA) at positions corresponding to residues 226 and 158. In some embodiments, HA polypeptide variants (e.g., H5 HA polypeptide variants) have sequence substitutions relative to a wild type parent HA (e.g., H5 HA) at positions corresponding to residues 228 and 158. In some embodiments, HA polypeptide variants (e.g., H5 HA polypeptide variants) have sequence substitutions relative to a wild type parent HA (e.g., H5 HA) at positions corresponding to residues 226 and 228.

In some embodiments, HA polypeptide variants (e.g., H5 HA polypeptide variants) have sequence substitutions that include a deletion in one or more of the loop regions of an HA polypeptide. In some embodiments, HA polypeptide variants (e.g., H5 HA polypeptide variants) have sequence substitutions that include a deletion at a site corresponding to the 128-137 loop region of an HA polypeptide. In some embodiments, HA polypeptide variants (e.g., H5 HA polypeptide variants) have sequence substitutions that include a deletion at one or more of amino acid positions corresponding to residues 128, 129, 130, 131, 132, 133, 134, 135, 136, and/or 137 of an HA polypeptide. In some embodiments, HA polypeptide variants (e.g., H5 HA polypeptide variants) have sequence substitutions that include a deletion at a site corresponding to the 128-134 loop region of an HA polypeptide. In some embodiments, HA polypeptide variants (e.g., H5 HA polypeptide variants) have sequence substitutions that include a deletion at one or more of amino acid positions corresponding to residues 128, 129, 130, 131, 132, 133, and/or 134 of an HA polypeptide. In some embodiments, HA polypeptide variants (e.g., H5 HA polypeptide variants) have sequence substitutions that include a deletion of an amino acid corresponding to residue 130. In some embodiments, such loop region substitutions can make a non-H2 HA polypeptide (e.g., an H5 HA polypeptide) more closely resemble (e.g., both structurally and functionally) an H2 HA polypeptide. In some embodiments, a deletion of an amino acid corresponding to residue 130 can make a non-H2 HA polypeptide (e.g., an H5 HA polypeptide) more closely resemble (e.g., both structurally and functionally) an H2 HA polypeptide.

In some embodiments, HA polypeptide variants (e.g., H5 HA polypeptide variants) have sequence substitutions relative to a wild type parent HA (e.g., H5 HA) at positions corresponding to one or more of residues 131, 132, 133, 135, 137, 155, 188, 192, 193, 221, 226, 227, 228, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, 6, 7, 8, 9, 10, 11, 12, 13, or 14 of residues 131, 132, 133, 135, 137, 155, 188, 192, 193, 221, 226, 227, 228, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 131, 132, 133, 135, 137, 155, 188, 192, 193, 221, 226, 227, and 228. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, 5, 6, 7, 8, 9, 10, 11, 12, or 13 of residues 131, 132, 133, 135, 137, 155, 188, 192, 193, 221, 226, 227, and 228.

In some embodiments, HA polypeptide variants (e.g., H5 HA polypeptide variants) have sequence substitutions relative to a wild type parent HA (e.g., H5 HA) at positions corresponding to one or more of residues 131, 132, 135, 188, 192, 221, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, 6, or 7 of residues 131, 132, 135, 188, 192, 221, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 131, 132, 135, 188, 192, and 221. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, 5, or 6 of residues 131, 132, 135, 188, 192, and 221.

In some embodiments, HA polypeptide variants (e.g., H5 HA polypeptide variants) have sequence substitutions relative to a wild type parent HA (e.g., H5 HA) at positions corresponding to one or more of residues 133, 137, 155, 193, 226, 227, 228, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, 6, 7, or of residues 133, 137, 155, 193, 226, 227, 228, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 133, 137, 155, 193, 226, 227, and 228. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, 5, 6, or 7 of residues 133, 137, 155, 193, 226, 227, and 228.

In some embodiments, HA polypeptide variants (e.g., H5 HA polypeptide variants) have sequence substitutions relative to a wild type parent HA (e.g., H5 HA) at positions corresponding to one or more of residues 130, 192, and 193. In some embodiments, HA polypeptide variants (e.g., H5 HA polypeptide variants) have sequence substitutions relative to a wild type parent HA (e.g., H5 HA) at positions corresponding to any 1, 2, or 3 of residues 130, 192, 193. In some embodiments, HA polypeptide variants (e.g., H5 HA polypeptide variants) have sequence substitutions relative to a wild type parent HA (e.g., H5 HA) at positions corresponding to (1) 130, and (2) one or both of residues 192 and 193.

In some embodiments, HA polypeptide variants (e.g., H5 HA polypeptide variants) have sequence substitutions relative to a wild type parent HA (e.g., H5 HA) at positions corresponding to one or more of residues 131, 132, 133, 135, 137, 155, 158, 160, 188, 192, 193, 221, 226, 227, 228, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, 6, 7, 8, 9, 10, 11, 12, 13, 14, 15, or 16 of residues 131, 132, 133, 135, 137, 155, 158, 160, 188, 192, 193, 221, 226, 227, 228, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 131, 132, 133, 135, 137, 155, 158, 160, 188, 192, 193, 221, 226, 227, and 228. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, 5, 6, 7, 8, 9, 10, 11, 12, 13, 14, or 15 of residues 131, 132, 133, 135, 137, 155, 158, 160, 188, 192, 193, 221, 226, 227, and 228.

In some embodiments, HA polypeptide variants (e.g., H5 HA polypeptide variants) have sequence substitutions relative to a wild type parent HA (e.g., H5 HA) at positions corresponding to one or more of residues 137, 188, 192, 193, 226, 228, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, 6, or 7 of residues 137, 188, 192, 193, 226, 228, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 137, 188, 192, 193, 226, and 228. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, 5, or 6 of residues 137, 188, 192, 193, 226, and 228.

In some embodiments, HA polypeptide variants (e.g., H5 HA polypeptide variants) have sequence substitutions relative to a wild type parent HA (e.g., H5 HA) at positions corresponding to one or more of residues 137, 188, 192, 193, 226, 227, 228, 131, 132, 133, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, 6, 7, 8, 9, 10, or 11 of residues 137, 188, 192, 193, 226, 227, 228, 131, 132, 133, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 137, 188, 192, 193, 226, 227, 228, 131, 132, and 133. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, 5, 6, 7, 8, 9, or 10 of residues 137, 188, 192, 193, 226, 227, 228, 131, 132, and 133.

In some embodiments, HA polypeptide variants (e.g., H5 HA polypeptide variants) have sequence substitutions relative to a wild type parent HA (e.g., H5 HA) at positions corresponding to one or more of residues 227, 131, 132, 133, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, or 5 of residues 227, 131, 132, 133, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 227, 131, 132, and 133. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, or 4 of residues 227, 131, 132, and 133.

In some embodiments, HA polypeptide variants (e.g., H5 HA polypeptide variants) have sequence substitutions relative to a wild type parent HA (e.g., H5 HA) at positions corresponding to one or more of residues 131, 133, 137, 155, 188, 192, 193, 226, 227, 228, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, 6, 7, 8, 9, 10, or 11 of residues 131, 133, 137, 155, 188, 192, 193, 226, 227, 228, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 131, 133, 137, 155, 188, 192, 193, 226, 227, and 228. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, 5, 6, 7, 8, 9, or 10 of residues 131, 133, 137, 155, 188, 192, 193, 226, 227, and 228.

In some embodiments, HA polypeptide variants (e.g., H5 HA polypeptide variants) have sequence substitutions relative to a wild type parent HA (e.g., H5 HA) at positions corresponding to one or more of residues 131, 133, 137, 155, 188, 192, 193, 226, 228, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, 6, 7, 8, 9, or 10 of residues 131, 133, 137, 155, 188, 192, 193, 226, 228, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 131, 133, 137, 155, 188, 192, 193, 226, and 228. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, 5, 6, 7, 8, or 9 of residues 131, 133, 137, 155, 188, 192, 193, 226, and 228.

In some embodiments, HA polypeptide variants (e.g., H5 HA polypeptide variants) have sequence substitutions relative to a wild type parent HA (e.g., H5 HA) at positions corresponding to one or more of residues 131, 133, 137, 155, 159, 160, 188, 192, 193, 226, 227, 228, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, 6, 7, 8, 9, 10, 11, 12, or 13 of residues 131, 133, 137, 155, 159, 160, 188, 192, 193, 226, 227, 228, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 131, 133, 137, 155, 159, 160, 188, 192, 193, 226, 227, and 228. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, 5, 6, 7, 8, 9, 10, 11, or 12 of residues 131, 133, 137, 155, 159, 160, 188, 192, 193, 226, 227, and 228.

In some embodiments, HA polypeptide variants (e.g., H5 HA polypeptide variants) have sequence substitutions relative to a wild type parent HA (e.g., H5 HA) at positions corresponding to one or more of residues 131, 133, 137, 155, 159, 160, 188, 192, 193, 226, 228, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, 6, 7, 8, 9, 10, 11, or 12 of residues 131, 133, 137, 155, 159, 160, 188, 192, 193, 226, 228, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 131, 133, 137, 155, 159, 160, 188, 192, 193, 226, and 228. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, 5, 6, 7, 8, 9, 10, or 11 of residues 131, 133, 137, 155, 159, 160, 188, 192, 193, 226, and 228.

In some embodiments, HA polypeptide variants (e.g., H5 HA polypeptide variants) have sequence substitutions relative to a wild type parent HA (e.g., H5 HA) at positions corresponding to one or more of residues 137, 188, 192, 193, 226, 228, 131, 132, 133, 221, 227, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, 6, 7, 8, 9, 10, 11, or 12 of residues 137, 188, 192, 193, 226, 228, 131, 132, 133, 221, 227, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 137, 188, 192, 193, 226, 228, 131, 132, 133, 221, and 227. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, 5, 6, 7, 8, 9, 10, or 11 of residues 137, 188, 192, 193, 226, 228, 131, 132, 133, 221, and 227.

In some embodiments, HA polypeptide variants (e.g., H5 HA polypeptide variants) have sequence substitutions relative to a wild type parent HA (e.g., H5 HA) at positions corresponding to one or more of residues 131, 132, 133, 221, 227, and 130. In some embodiments, HA polypeptide variants (e.g., H5 HA polypeptide variants) have sequence substitutions relative to a wild type parent HA (e.g., H5 HA) at positions corresponding to any 1, 2, 3, 4, 5, or 6 of residues 131, 132, 133, 221, 227, and 130. In some embodiments, HA polypeptide variants (e.g., H5 HA polypeptide variants) have sequence substitutions relative to a wild type parent HA (e.g., H5 HA) at positions corresponding to (1) 130, and (2) one or more of residues 131, 132, 133, 221, and 227. In some embodiments, HA polypeptide variants (e.g., H5 HA polypeptide variants) have sequence substitutions relative to a wild type parent HA (e.g., H5 HA) at positions corresponding to (1) 130, and (2) any 1, 2, 3, 4, or 5 of residues 131, 132, 133, 221, and 227.

In some embodiments, an HA polypeptide variant, and particularly an H5 polypeptide variant, has one or more amino acid substitutions relative to a wild type parent HA at residues selected from amino acids located in the region of the receptor that directly binds to the glycan, including but not limited to residues 98, 136, 153, 155, 183, and 194. In some embodiments, an HA polypeptide variant in accordance with the invention, and particularly an H5 polypeptide variant, has one or more amino acid substitutions relative to a wild type parent HA at residues selected from amino acids located adjacent to the region of the receptor that directly binds the glycan, including but not limited to (a) residues 98 and 195, (b) residues 98, 138, 186, 187, 195, and 228), or (c) residues 138, 186, 187, and 228.

In some embodiments, an HA polypeptide variant in accordance with the invention, and particularly an H5 variant has one or more of the following amino acid substitutions: Ser132Thr, Ala133Thr, Ser133Thr, Ser137Ala, Ser137Arg, Ile155Thr, Lys156Glu, Asn158Xaa (wherein Xaa=any amino acid besides Asn), Thr160Ala, Asn186Pro, Asp187Ser, Asp187Thr, Ala188Glu, Ala188Asp, Ala189Gln, Ala189Lys, Ala189Thr, Glu190Asp, Glu190Thr, Thr192Arg/Lys, Lys193Arg, Lys193Asn, Lys193His, Lys193Ser, Lys/Arg193Thr/Ala/Met/Val, Ser221Pro, Gly225Asp, Gln226Ile, Gln226Leu, Gln226Val, Ser227Ala, Gly228Ser.

In some embodiments, an HA polypeptide variant (e.g., an H5 HA polypeptide variant) in accordance with the invention has an amino acid substitution at a position corresponding to residue 192, which switches the charge at that position. In some embodiments, an HA polypeptide variant (e.g., an H5 HA polypeptide variant) in accordance with the invention has an amino acid substitution at a position corresponding to residue 193, which switches the charge at that position. For example, in some embodiments, an HA polypeptide (e.g., an H5 HA polypeptide) in accordance with the invention has a Thr or a hydrophobic residue (e.g., Val or Ile) at a position corresponding to residue 192, and an HA polypeptide variant (e.g., an H5 HA polypeptide variant) (e.g., a human-adapted variant) has a hydrophilic residue at a position corresponding to residue 192. In some embodiments, an HA polypeptide variant (e.g., an H5 HA polypeptide variant) (e.g., a human-adapted variant) has a hydrophilic residue at a position corresponding to residue 192. To give another example, in some embodiments, an HA polypeptide (e.g., an H5 HA polypeptide) in accordance with the invention has a Thr or a hydrophobic residue (e.g., Val or Ile) at a position corresponding to residue 192, and an HA polypeptide variant (e.g., an H5 HA polypeptide variant) (e.g., a human-adapted variant) has a basic residue (e.g., Lys or Arg) at a position corresponding to residue 192. In some embodiments, an HA polypeptide variant (e.g., an H5 HA polypeptide variant) (e.g., a human-adapted variant) has a basic residue (e.g., Lys or Arg) at a position corresponding to residue 192. To give yet another example, in some embodiments, an HA polypeptide (e.g., an H5 HA polypeptide) in accordance with the invention has a basic residue (e.g., Lys or Arg) at a position corresponding to residue 193, and an HA polypeptide variant (e.g., an H5 HA polypeptide variant) (e.g., a human-adapted variant) has a neutral or acidic residue at a position corresponding to residue 193. In some embodiments, an HA polypeptide variant (e.g., an H5 HA polypeptide variant) (e.g., a human-adapted variant) has a neutral or acidic residue at a position corresponding to residue 193. In some embodiments, an HA polypeptide variant (e.g., an H5 HA polypeptide variant) (e.g., a human-adapted variant) has a Thr, Ala, Met, or Val at a position corresponding to residue 193.

In some embodiments, human adaptation of HA polypeptides (e.g., H5 HA polypeptides) is associated with the proper(ies) of the residue at position 188. In H5 HA, residue 188 is frequently Ala, which makes contacts with Thr or a hydrophobic residue at 192. In contrast, in H2 HA, residue 188 is frequently Glu or Asp, which makes contacts with Arg or Lys at 192. Hence, in some embodiments, an HA polypeptide variant (e.g., an H5 HA polypeptide variant) has a Glu at position 188. In some embodiments, an HA polypeptide variant (e.g., an H5 HA polypeptide variant) has an Asp at position 188. In some embodiments, an HA polypeptide variant (e.g., an H5 HA polypeptide variant) has an Ala188Glu substitution. In some embodiments, an HA polypeptide variant (e.g., an H5 HA polypeptide variant) has an Ala188Asp substitution.

In some embodiments, an HA polypeptide (e.g., an H5 HA polypeptide) has an Ala at a position corresponding to residue 188 and a Thr at a position corresponding to residue 192. In some embodiments, an HA polypeptide (e.g., an H5 HA polypeptide) has an Ala at a position corresponding to residue 188 and a hydrophobic residue at a position corresponding to residue 192. In some embodiments, an HA polypeptide variant (e.g., an H5 HA polypeptide variant) has a Glu at a position corresponding to residue 188 and an Arg at a position corresponding to residue 192. In some embodiments, an HA polypeptide variant (e.g., an H5 HA polypeptide variant) has an Asp at a position corresponding to residue 188 and an Arg at a position corresponding to residue 192. In some embodiments, an HA polypeptide variant (e.g., an H5 HA polypeptide variant) has a Glu at a position corresponding to residue 188 and a Lys at a position corresponding to residue 192. In some embodiments, an HA polypeptide variant (e.g., an H5 HA polypeptide variant) has an Asp at a position corresponding to residue 188 and a Lys at a position corresponding to residue 192.

In some embodiments, an HA polypeptide (e.g., an H5 HA polypeptide) has an Ala at a position corresponding to residue 188, a Thr at a position corresponding to residue 192, and a Lys at a position corresponding to residue 193. In some embodiments, an HA polypeptide (e.g., an H5 HA polypeptide) has an Ala at a position corresponding to residue 188, a hydrophobic residue at a position corresponding to residue 192, and a Lys at a position corresponding to residue 193. In some embodiments, an HA polypeptide (e.g., an H5 HA polypeptide) has an Ala at a position corresponding to residue 188, a Thr at a position corresponding to residue 192, and an Arg at a position corresponding to residue 193. In some embodiments, an HA polypeptide (e.g., an H5 HA polypeptide) has an Ala at a position corresponding to residue 188, a hydrophobic residue at a position corresponding to residue 192, and an Arg at a position corresponding to residue 193. In some embodiments, an HA polypeptide variant (e.g., an H5 HA polypeptide variant) has a Glu at a position corresponding to residue 188, an Arg at a position corresponding to residue 192, and a Thr at a position corresponding to residue 193. In some embodiments, an HA polypeptide variant (e.g., an H5 HA polypeptide variant) has an Asp at a position corresponding to residue 188, an Arg at a position corresponding to residue 192, and a Thr at a position corresponding to residue 193. In some embodiments, an HA polypeptide variant (e.g., an H5 HA polypeptide variant) has a Glu at a position corresponding to residue 188, a Lys at a position corresponding to residue 192, and a Thr at a position corresponding to residue 193. In some embodiments, an HA polypeptide variant (e.g., an H5 HA polypeptide variant) has an Asp at a position corresponding to residue 188, a Lys at a position corresponding to residue 192, and a Thr at a position corresponding to residue 193. In some embodiments, an HA polypeptide variant (e.g., an H5 HA polypeptide variant) has a Glu at a position corresponding to residue 188, an Arg at a position corresponding to residue 192, and a Thr, Ala, Met, or Val at a position corresponding to residue 193. In some embodiments, an HA polypeptide variant (e.g., an H5 HA polypeptide variant) has an Asp at a position corresponding to residue 188, an Arg at a position corresponding to residue 192, and a Thr, Ala, Met, or Val at a position corresponding to residue 193. In some embodiments, an HA polypeptide variant (e.g., an H5 HA polypeptide variant) has a Glu at a position corresponding to residue 188, a Lys at a position corresponding to residue 192, and a Thr, Ala, Met, or Val at a position corresponding to residue 193. In some embodiments, an HA polypeptide variant (e.g., an H5 HA polypeptide variant) has an Asp at a position corresponding to residue 188, a Lys at a position corresponding to residue 192, and a Thr, Ala, Met, or Val at a position corresponding to residue 193.

In some embodiments, an HA polypeptide (e.g., an H5 HA polypeptide) has an Ala at a position corresponding to residue 131. In some embodiments, an HA polypeptide variant (e.g., an H5 HA polypeptide variant) has a Thr at a position corresponding to residue 131.

In some embodiments, an HA polypeptide (e.g., an H5 HA polypeptide) has a Ser at a position corresponding to residue 132. In some embodiments, an HA polypeptide variant (e.g., an H5 HA polypeptide variant) has a Thr at a position corresponding to residue 132.

In some embodiments, an HA polypeptide (e.g., an H5 HA polypeptide) has a Ser at a position corresponding to residue 133. In some embodiments, an HA polypeptide variant (e.g., an H5 HA polypeptide variant) has a Thr at a position corresponding to residue 133.

In some embodiments, an HA polypeptide (e.g., an H5 HA polypeptide) includes Ala, Thr, and/or Ser at any position corresponding to residues 131, 132, and/or 133. In some embodiments, an HA polypeptide variant (e.g., an H5 HA polypeptide variant) includes Ala, Thr, and/or Ser at any position corresponding to residues 131, 132, and/or 133. In some embodiments, an HA polypeptide variant (e.g., an H5 HA polypeptide variant) includes Thr at all of positions corresponding to 131, 132, and 133.

In some embodiments, an HA polypeptide (e.g., an H5 HA polypeptide) has a Val at a position corresponding to residue 135. In some embodiments, an HA polypeptide variant (e.g., an H5 HA polypeptide variant) has any amino acid other than Val at a position corresponding to residue 135.

In some embodiments, an HA polypeptide (e.g., an H5 HA polypeptide) has a Ser at a position corresponding to residue 137. In some embodiments, an HA polypeptide variant (e.g., an H5 HA polypeptide variant) has an Arg at a position corresponding to residue 137.

In some embodiments, an HA polypeptide (e.g., an H5 HA polypeptide) has an Ile at a position corresponding to residue 155. In some embodiments, an HA polypeptide variant (e.g., an H5 HA polypeptide variant) has a Thr at a position corresponding to residue 155. In some embodiments, an HA polypeptide (e.g., an H5 HA polypeptide) includes a Thr at a position corresponding to residue 155. In some embodiments, an HA polypeptide variant (e.g., an H5 HA polypeptide variant) includes a Thr at a position corresponding to residue 155.

In some embodiments, an HA polypeptide (e.g., an H5 HA polypeptide) has a Ser at a position corresponding to residue 221. In some embodiments, an HA polypeptide variant (e.g., an H5 HA polypeptide variant) has a Pro at a position corresponding to residue 221.

In some embodiments, an HA polypeptide (e.g., an H5 HA polypeptide) includes a Ser at a position corresponding to residue 221. In some embodiments, an HA polypeptide variant (e.g., an H5 HA polypeptide variant) includes a Pro at a position corresponding to residue 221. Without wishing to be bound by any one particular theory, Pro221 might influence conformation of 220 loop which is involved with the RBS of H2 HA.

In some embodiments, an HA polypeptide (e.g., an H5 HA polypeptide) has a Gln at a position corresponding to residue 226. In some embodiments, an HA polypeptide variant (e.g., an H5 HA polypeptide variant) has a Leu at a position corresponding to residue 226.

In some embodiments, an HA polypeptide (e.g., an H5 HA polypeptide) has a Ser at a position corresponding to residue 227. In some embodiments, an HA polypeptide variant (e.g., an H5 HA polypeptide variant) has a Gly at a position corresponding to residue 227.

In some embodiments, an HA polypeptide (e.g., an H5 HA polypeptide) has a Gly at a position corresponding to residue 228. In some embodiments, an HA polypeptide variant (e.g., an H5 HA polypeptide variant) has a Ser at a position corresponding to residue 228.

In some embodiments, an HA polypeptide (e.g., an H5 HA polypeptide) includes Gln, Ser, and Gly residues at positions corresponding to residues 226, 227, and 228, respectively. In some embodiments, an HA polypeptide variant (e.g., an H5 HA polypeptide variant) includes a Leu, Gly, and Ser at positions corresponding to residues 226, 227, and 228, respectively.

In some embodiments, an HA polypeptide variant in accordance with the invention, and particularly an H5 variant has one or more of the following amino acids at the indicated positions (the numbering of these positions corresponds to the numbering of H3 HA):

Glu190Asp, Lys193Ser, Gly225Asp, Gln226Leu
Glu190Asp, Lys193Ser, Gln226Leu, Gly228Ser
Ala189Gln, Lys193Ser, Thr160Ala
Ala189Gln, Lys193Ser, Gln226Leu, Gly228Ser
Asp187Ser/Thr, Ala189Gln, Lys193Ser, Gln226Leu, Gly228Ser
Ala189Lys, Lys193Asn, Gln226Leu, Gly228Ser
Asp187Ser/Thr, Ala189Lys, Lys193Asn, Gln226Leu, Gly228Ser
Lys156Glu, Ala189Lys, Lys193Asn, Gln226Leu, Gly228Ser
Lys193His, Gln226Leu/Ile/Val, Gly228Ser
Lys193Arg, Gln226Leu/Ile/Val, Gly228Ser
Ala189Lys, Lys193Asn, Gly225Asp
Lys156Glu, Ala189Lys, Lys193Asn, Gly225Asp
Ser137Ala, Lys156Glu, Ala189Lys, Lys193Asn, Gly225Asp
Glu190Thr, Lys193Ser, Gly225Asp
Asp187Thr, Ala189Thr, Glu190Asp, Lys193Ser, Gly225Asp
Asn186Pro, Asp187Thr, Ala189Thr, Glu190Asp, Lys193Ser, Gly225Asp
Asn186Pro, Asp187Thr, Ala189Thr, Glu190Asp, Lys193Ser, Gly225Asp, Ser227Ala
Gln226Leu, Gly228Ser, Thr160Ala
Gln226Leu, Gly228Ser, Thr160Ala
Gly228Ser, Thr160Ala
Gln226Leu, Thr160Ala
Gln226Leu, Gly228Ser
Thr160Ala
Gln226Leu, Gly228Ser, Asn158Xaa (wherein Xaa=any amino acid besides Asn)
Gly228Ser, Asn158Xaa
Gln226Leu, Asn158Xaa
Gln226Leu, Gly228Ser
Asn158Xaa
Δ130 (wherein "Δ130" indicates a deletion at an amino acid corresponding to position 130) plus any possible combination of mutations at positions corresponding to residues 131, 132, 133, 135, 137, 155, 188, 192, 193, 221, 226, 227, and 228

Δ130 plus any possible combination of mutations at positions corresponding to residues 131, 132, 135, 188, 192, and 221
Δ130 plus any possible combination of mutations at positions corresponding to residues 133, 137, 155, 193, 226, 227, and 228
Δ130 plus any possible combination of mutations at positions corresponding to residues 131, 132, 133, 135, 137, 155, 158, 160, 188, 192, 193, 221, 226, 227, and 228
Δ130 plus any possible combination of mutations at positions corresponding to residues 131, 133, 137, 155, 188, 192, 193, 226, 227, and 228
Δ130 plus any possible combination of mutations at positions corresponding to residues 131, 133, 137, 155, 188, 192, 193, 226, and 228
Δ130 plus any possible combination of mutations at positions corresponding to residues 131, 133, 137, 155, 159, 160, 188, 192, 193, 226, 227, and 228
Δ130 plus any possible combination of mutations at positions corresponding to residues 131, 133, 137, 155, 159, 160, 188, 192, 193, 226, and 228
Δ130 plus any possible combination of mutations at positions corresponding to residues 137, 188, 192, 193, 226, 228, 131, 132, 133, 221, and 227
Δ130 plus any possible combination of mutations at positions corresponding to residues 131, 132, 133, 221, and 227
Δ130 plus any possible combination of mutations at positions corresponding to residues 137, 188, 192, 193, 226, and 228
Δ130 plus any possible combination of mutations at positions corresponding to residues 137, 188, 192, 193, 226, 227, 228, 131, 132, and 133
Δ130 plus any possible combination of mutations at positions corresponding to residues 227, 131, 132, and 133
Gln226Leu, Gly228Ser, Thr160Ala, Δ130
Gln226Leu, Gly228Ser, Δ130
Gln226Leu, Thr160Ala, Δ130
Gly228Ser, Thr160Ala, Δ130
Gln226Leu, Δ130
Gly228Ser, Δ130
Thr160Ala, Δ130
Δ130
Δ130, Ala131Thr, Leu133Thr, Ser137Arg, Ile155Thr, Ala188Glu, Thr/Ile192Arg/Lys, Arg/Lys193Thr/Ala, Gln226Leu, Ser227Gly, Gly228Ser
Δ130, Ala131Thr, Leu133Thr, Ser137Arg, Ile155Thr, Ala188Glu, Thr/Ile192Arg/Lys, Arg/Lys193Thr/Ala, Gln226Leu, Gly228Ser
Δ130, Ala131Thr, Leu133Thr, Ser137Arg, Ile155Thr, Asn159Asp (or Thr160Ala or both), Ala188Glu, Thr/Ile192Arg/Lys, Arg/Lys193Thr/Ala, Gln226Leu, Ser227Gly, Gly228Ser
Δ130, Ala131Thr, Leu133Thr, Ser137Arg, Ile155Thr, Asn159Asp (or Thr160Ala or both), Ala188Glu, Thr/Ile192Arg/Lys, Arg/Lys193Thr/Ala, Gln226Leu, Gly228Ser
Δ130, Ser137Arg, Ala188Glu, Thr192Arg/Lys, Arg/Lys193Thr/Met/Ala/Val, Gln226Leu, Gly228Ser
Δ130, Ser137Arg, Ala188Glu, Thr192Arg/Lys, Arg/Lys193Thr/Met/Ala/Val, Gln226Leu, Gly228Ser, Xaa131Ser/Thr, Xaa132Ser/Thr, Xaa133Ser/Thr, Ser221Pro, Ser227Gly (wherein Xaa=any amino acid)
Δ130, Xaa131Ser/Thr, Xaa132Ser/Thr, Xaa133Ser/Thr, Ser221Pro, Ser227Gly (wherein Xaa=any amino acid)

Δ130, Xaa192Xaa' (wherein Xaa=any hydrophobic amino acid, and Xaa'=any hydrophilic amino acid)
Δ130, Xaa192Lys/Arg (wherein Xaa=any hydrophobic residue)
Δ130, Xaa193Xaa' (wherein Xaa=a basic residue, e.g., Lys or Arg, and Xaa'=a neutral or acidic residue)
Δ130, Lys/Arg193Thr/Ala/Met/Val
Δ130, Xaa192Xaa' (wherein Xaa=any hydrophobic amino acid, and Xaa'=any hydrophilic amino acid), Xaa193Xaa' (wherein Xaa=a basic residue, e.g., Lys or Arg, and Xaa'=a neutral or acidic residue)
Δ130, Xaa192Lys/Arg (wherein Xaa=any hydrophobic residue), Xaa193Xaa' (wherein Xaa=a basic residue, e.g., Lys or Arg, and Xaa'=a neutral or acidic residue)
Δ130, Xaa192Xaa' (wherein Xaa=any hydrophobic amino acid, and Xaa'=any hydrophilic amino acid), Lys/Arg193Thr/Ala/Met/Val
Δ130, Xaa192Lys/Arg (wherein Xaa=any hydrophobic residue), Lys/Arg193Thr/Ala/Met/Val
Δ130, Ala188Glu
Δ130, Ala188Asp
Δ130, Xaa192Xaa' (wherein Xaa=any hydrophobic amino acid, and Xaa'=any hydrophilic amino acid), Ala188Glu
Δ130, Xaa192Lys/Arg (wherein Xaa=any hydrophobic residue), Ala188Glu
Δ130, Xaa193Xaa' (wherein Xaa=a basic residue, e.g., Lys or Arg, and Xaa'=a neutral or acidic residue), Ala188Glu
Δ130, Lys/Arg193Thr/Ala/Met/Val, Ala188Glu
Δ130, Xaa192Xaa' (wherein Xaa=any hydrophobic amino acid, and Xaa'=any hydrophilic amino acid), Ala188Asp
Δ130, Xaa192Lys/Arg (wherein Xaa=any hydrophobic residue), Ala188Asp
Δ130, Xaa193Xaa' (wherein Xaa=a basic residue, e.g., Lys or Arg, and Xaa'=a neutral or acidic residue), Ala188Asp
Δ130, Lys/Arg193Thr/Ala/Met/Val, Ala188Asp
Δ130, Xaa192Xaa' (wherein Xaa=any hydrophobic amino acid, and Xaa'=any hydrophilic amino acid), Xaa193Xaa' (wherein Xaa=a basic residue, e.g., Lys or Arg, and Xaa'=a neutral or acidic residue), Ala188Glu
Δ130, Xaa192Lys/Arg (wherein Xaa=any hydrophobic residue), Xaa193Xaa' (wherein Xaa=a basic residue, e.g., Lys or Arg, and Xaa'=a neutral or acidic residue), Ala188Glu
Δ130, Xaa192Xaa' (wherein Xaa=any hydrophobic amino acid, and Xaa'=any hydrophilic amino acid), Lys/Arg193Thr/Ala/Met/Val, Ala188Glu
Δ130, Xaa192Lys/Arg (wherein Xaa=any hydrophobic residue), Lys/Arg193Thr/Ala/Met/Val, Ala188Glu
Δ130, Xaa192Xaa' (wherein Xaa=any hydrophobic amino acid, and Xaa'=any hydrophilic amino acid), Xaa193Xaa' (wherein Xaa=a basic residue, e.g., Lys or Arg, and Xaa'=a neutral or acidic residue), Ala188Asp
Δ130, Xaa192Lys/Arg (wherein Xaa=any hydrophobic residue), Xaa193Xaa' (wherein Xaa=a basic residue, e.g., Lys or Arg, and Xaa'=a neutral or acidic residue), Ala188Asp
Δ130, Xaa192Xaa' (wherein Xaa=any hydrophobic amino acid, and Xaa'=any hydrophilic amino acid), Lys/Arg193Thr/Ala/Met/Val, Ala188Asp
Δ130, Xaa192Lys/Arg (wherein Xaa=any hydrophobic residue), Lys/Arg193Thr/Ala/Met/Val, Ala188Asp In some embodiments, the present invention provides HA polypeptides (e.g., HA polypeptide variants, engineered HA polypeptides, and/or engineered HA polypeptide variants) whose amino acid sequence includes an element as set forth below:

X190, X193, X225 and X226
X190, X193, X226 and X228
X189, X193, X160
X189, X193, X226, X228
X187, X189, X193, X226, X228
X189, X193, X226, X228
X187, X189, X193, X226, X228
X156, X189, X193, X226, X228
X193, X226, X228
X193, X226, X228
X189, X193, X225
X156, X189, X193, X225
X137, X156, X189, X193, X225
X190, X193, X225
X187, X189, X190, X193, X225
X186, X187, X189, X190, X193, X225
X186, X187, X189, X190, X193, X225, X227
X226, X228, X160
X226, X228, X160
X228, X160
X226, X160
X226, X228
X160
X226, X228, Xaa158 (wherein Xaa=any amino acid besides Asn)
X228, Xaa158 (wherein Xaa=any amino acid besides Asn)
X226, Xaa158 (wherein Xaa=any amino acid besides Asn)
X226, X228
X158 (wherein Xaa=any amino acid besides Asn)
X130 plus any possible combination of X131, X132, X133, X135, X137, X155, X188, X192, X193, X221, X226, X227, and X228
X130 plus any possible combination of X131, X132, X135, X188, X192, and X221
X130 plus any possible combination of X133, X137, X155, X193, X226, X227, and X228
X130 plus any possible combination of X131, X132, X133, X135, X137, X155, Xaa158 (wherein Xaa=any amino acid besides Asn), X160, X188, X192, X193, X221, X226, X227, and X228
X130 plus any possible combination of X131, X133, X137, X155, X188, X192, X193, X226, X227, and X228
X130 plus any possible combination of X131, X133, X137, X155, X188, X192, X193, X226, and X228
X130 plus any possible combination of X131, X133, X137, X155, X159, X160, X188, X192, X193, X226, X227, and X228
X130 plus any possible combination of X131, X133, X137, X155, X159, X160, X188, X192, X193, X226, and X228
X130 plus any possible combination of X137, X188, X192, X193, X226, X228, X131, X132, X133, X221, and X227
X130 plus any possible combination of X131, X132, X133, X221, and X227
X130 plus any possible combination of X137, X188, X192, X193, X226, and X228
X130 plus any possible combination of X137, X188, X192, X193, X226, X227, X228, X131, X132, and X133

X130 plus any possible combination of X227, X131, X132, and X133
X226, X228, X160, X130
X226, X228, X130
X226, X160, X130
X228, X160, X130
X226, X130
X228, X130
X160, X130
X130
X130, X131, X133, X137, X155, X188, X192, X193, X226, X227, X228
X130, X131, X133, X137, X155, X188, X192, X193, X226, X228
X130, X131, X133, X137, X155, X159, X160, X188, X192, X193, X226, X227, X228
X130, X131, X133, X137, X155, X159, X160, X188, X192, X193, X226, X228
X130, X137, X188, X192, X193, X226, X228
X130, X137, X188, X192, X193, X226, X228, X131, X132, X133, X221, X227
X130, X131, X132, X133, X221, X227
X130, X192
X130, X193
X130, X192, X193
X130, X188
X130, X192, X188
X130, X193, X188
X130, X192, X193, X188
wherein X=any amino acid (unless otherwise specified above), and/or X=a missing amino acid. The numbering of these positions corresponds to the numbering of H3 HA.

In some embodiments X130 is a deletion at position 130. In some embodiments, X160 is an Ala. In some embodiments, X158 is any amino acid other than Asn.

In some such embodiments, the H5 HA polypeptide variant has at least one further substitution as compared with a wild type H5 HA, such that affinity and/or specificity of the variant for umbrella glycans is increased.

In some such embodiments, the HA polypeptide has at least one further substitution as compared with a wild type HA, such that affinity and/or specificity of the variant for umbrella glycans is increased.

In some embodiments, HA polypeptides in accordance with the invention (including H5 HA polypeptide variants) have sequences that include L226, S228, and A160. In some embodiments, HA polypeptides in accordance with the invention (including H5 HA polypeptide variants) have sequences that include L226 and A160. In some embodiments, HA polypeptides in accordance with the invention (including H5 HA polypeptide variants) have sequences that include S228 and A160. In some embodiments, HA polypeptides in accordance with the invention (including H5 HA polypeptide variants) have sequences that include A160.

In some embodiments, HA polypeptides in accordance with the invention (including H5 HA polypeptide variants) have sequences that include L226, S228, and X158 (wherein X=any amino acid besides Asn). In some embodiments, HA polypeptides in accordance with the invention (including H5 HA polypeptide variants) have sequences that include L226 and X158. In some embodiments, HA polypeptides in accordance with the invention (including H5 HA polypeptide variants) have sequences that include S228 and X158. In some embodiments, HA polypeptides in accordance with the invention (including H5 HA polypeptide variants) have sequences that include X158.

In some embodiments, HA polypeptides in accordance with the invention (including H5 HA polypeptide variants) have sequences that include Δ130 and any possible combination of mutations at positions corresponding to residues 131, 132, 133, 135, 137, 155, 158, 160, 188, 192, 193, 221, 226, 227, and 228.

In some embodiments, HA polypeptides in accordance with the invention (including H5 HA polypeptide variants) have sequences that include Δ130, L226, S228, A160 and any possible combination of mutations at positions corresponding to residues 131, 132, 133, 135, 137, 155, 158, 188, 192, 193, 221, and 227. In some embodiments, HA polypeptides in accordance with the invention (including H5 HA polypeptide variants) have sequences that include Δ130, L226, A160, and any possible combination of mutations at positions corresponding to residues 131, 132, 133, 135, 137, 155, 158, 188, 192, 193, 221, 227, and 228. In some embodiments, HA polypeptides in accordance with the invention (including H5 HA polypeptide variants) have sequences that include Δ130, S228, A160, and any possible combination of mutations at positions corresponding to residues 131, 132, 133, 135, 137, 155, 158, 188, 192, 193, 221, and 227. In some embodiments, HA polypeptides in accordance with the invention (including H5 HA polypeptide variants) have sequences that include Δ130, L226, S228, and any possible combination of mutations at positions corresponding to residues 131, 132, 133, 135, 137, 155, 158, 160, 188, 192, 193, 221, and 227.

In some embodiments, HA polypeptides in accordance with the invention (including H5 HA polypeptide variants) have sequences that include Δ130, A160, and any possible combination of mutations at positions corresponding to residues 131, 132, 133, 135, 137, 155, 158, 188, 192, 193, 221, 226, 227, and 228. In some embodiments, HA polypeptides in accordance with the invention (including H5 HA polypeptide variants) have sequences that include Δ130, L226, and any possible combination of mutations at positions corresponding to residues 131, 132, 133, 135, 137, 155, 158, 160, 188, 192, 193, 221, and 227, and 228. In some embodiments, HA polypeptides in accordance with the invention (including H5 HA polypeptide variants) have sequences that include Δ130, S228, and any possible combination of mutations at positions corresponding to residues 131, 132, 133, 135, 137, 155, 158, 160, 188, 192, 193, 221, 226, and 227.

In some embodiments, HA polypeptides in accordance with the invention (including H5 HA polypeptide variants) have sequences that include Δ130, L226, S228, X158 (wherein X=any amino acid besides Asn) and any possible combination of mutations at positions corresponding to residues 131, 132, 133, 135, 137, 155, 160, 188, 192, 193, 221, and 227. In some embodiments, HA polypeptides in accordance with the invention (including H5 HA polypeptide variants) have sequences that include Δ130, L226, X158, and any possible combination of mutations at positions corresponding to residues 131, 132, 133, 135, 137, 155, 160, 188, 192, 193, 221, 227, and 228. In some embodiments, HA polypeptides in accordance with the invention (including H5 HA polypeptide variants) have sequences that include Δ130, S228, X158, and any possible combination of mutations at positions corresponding to residues 131, 132, 133, 135, 137, 155, 160, 188, 192, 193, 221, and 227. In some embodiments, HA polypeptides in accordance with the invention (including H5 HA polypeptide variants) have sequences that include Δ130, L226, S228, and any possible combination of mutations at positions corresponding to residues 131, 132, 133, 135, 137, 155, 158, 160, 188, 192, 193, 221, and 227.

In some embodiments, HA polypeptides in accordance with the invention (including H5 HA polypeptide variants) have sequences that include Δ130, X158 (wherein X=any amino acid besides Asn), and any possible combination of mutations at positions corresponding to residues 131, 132, 133, 135, 137, 155, 160, 188, 192, 193, 221, 226, 227, and 228.

In some embodiments, H5 HA polypeptide variants (e.g., H5 HA polypeptide variants) in accordance with the invention have an open binding site as compared with a parent HA, and particularly with a parent wild type HAs.

In some embodiments, HA polypeptides (e.g., H5 HA polypeptides) in accordance with the invention bind to the following α2-6 sialylated glycans:

and combinations thereof. In some embodiments, H5 HA polypeptides in accordance with the invention bind to glycans of the structure:

and combinations thereof; and/or and/or and/or and combinations thereof. In some embodiments, HA polypeptides (e.g., H5 HA polypeptides) in accordance with the invention bind to and/or in some embodiments to in some embodiments to and in some embodiments to and/or In some embodiments, HA polypeptides (e.g., H5 HA polypeptides) in accordance with the invention bind to umbrella topology glycans. In some embodiments, H5 HA polypeptides in accordance with the invention bind to at least some of the glycans (e.g., α2-6 sialylated glycans) depicted in FIG. 9. In some embodiments, HA polypeptides (e.g., H5 HA polypeptides) in accordance with the invention bind to multiple glycans depicted in FIG. 9.

In some embodiments, HA polypeptides (e.g., H5 HA polypeptides) in accordance with the invention bind to at least about 10%, about 15%, about 20%, about 25%, about 30% about 35%, about 40%, about 45%, about 50%, about 55%, about 60%, about 65%, about 70%, about 75%, about 80%, about 85%, about 90% about 95%, or more of the glycans found on HA receptors in human upper respiratory tract tissues (e.g., epithelial cells).

In one aspect, the present invention provides the particular recognition that high affinity binding to umbrella-topology glycans alone may not be sufficient to confer effective transmission to/infectivity of humans. The present invention provides the insight that reduced binding to cone-topology glycans may also be important. In some embodiments, high affinity binding to umbrella-topology glycans and reduced affinity binding to cone-topology glycans may be involved in conferring effective transmission to/infectivity of humans. In some embodiments, high affinity binding to umbrella-topology glycans is sufficient to confer effective transmission to/infectivity of humans. In some embodiments, high affinity binding to umbrella-topology glycans is sufficient to confer effective transmission to/infectivity of humans, even if the affinity of binding to cone-topology glycans is not reduced (e.g., unchanged, increased, etc.).

In some embodiments, increased affinity and/or specificity of binding of an HA polypeptide variant (e.g., an H5 HA polypeptide variant) to umbrella-topology glycans and reduced affinity and/or specificity binding to cone-topology glycans may be involved in increasing or enhancing transmission to/infectivity of humans relative to a reference polypeptide (e.g., the HA polypeptide variant's cognate parent HA polypeptide). In some embodiments, increased affinity and/or specificity of binding of an HA polypeptide variant (e.g., an H5 HA polypeptide variant) to umbrella-topology glycans is sufficient to increase or enhance transmission to/infectivity of humans relative to a reference polypeptide (e.g., the HA polypeptide variant's cognate parent HA polypeptide). In some embodiments, increased affinity and/or specificity of binding of an HA polypeptide variant (e.g., an H5 HA polypeptide variant) to umbrella-topology glycans is sufficient to increase or enhance transmission to/infectivity of humans relative to a reference polypeptide (e.g., the HA polypeptide variant's cognate parent HA polypeptide), even if the affinity and/or specificity of binding to cone-topology glycans is not reduced (e.g., unchanged, increased, etc.). In some embodiments, increased affinity and/or specificity of binding of an HA polypeptide variant (e.g., an H5 HA polypeptide variant) to umbrella-topology glycans is sufficient to increase or enhance transmission to/infectivity of humans relative to a reference polypeptide (e.g., the HA polypeptide variant's cognate parent HA polypeptide), even if the affinity and/or specificity of binding to cone-topology glycans is equal to and/or greater than that of the affinity and/or specificity of binding to umbrella-topology glycans.

Portions or Fragments of HA Polypeptides

The present invention further provides characteristic portions (which may or may not be binding agents) of HA polypeptides in accordance with the invention and nucleic acids that encode them. In general, a characteristic portion is one that contains a continuous stretch of amino acids, or a collection of continuous stretches of amino acids, that together are characteristic of the HA polypeptide. Each such continuous stretch generally will contain at least two amino acids. Furthermore, those of ordinary skill in the art will appreciate that typically at least 5, at least 10, at least 15, at least 20 or more amino acids are required to be characteristic of a H5 HA polypeptide. In general, a characteristic portion is one that, in addition to the sequence identity specified above, shares at least one functional characteristic with the relevant intact HA polypeptide. In some embodiments, characteristic portions of HA polypeptides in accordance with the invention share glycan binding characteristics with the relevant full-length HA polypeptides.

Non-HA Polypeptides

In some embodiments, binding agents provided in accordance with the present invention are polypeptides whose amino acid sequence does not include a characteristic HA sequence. Such polypeptides are referred to herein as "Non-HA polypeptides". In some embodiments, a Non-HA polypeptide has an amino acid sequence selected in advance (e.g., via rational design, including for example, introduction of strategic amino acid alterations [e.g., additions, deletions, and/or substitutions] as compared with a reference sequence). In some embodiments, a Non-HA polypeptide has an amino acid sequence that is determined stochastically and, for example, identified on the basis of the desirable binding characteristics defined herein.

Antibodies

In some embodiments, binding agents provided in accordance with the present invention are antibodies (e.g., that bind to umbrella topology glycans and/or to umbrella topology glycan mimics). Antibodies suitable for the invention include antibodies or fragments of antibodies that bind immunospecifically to any umbrella topology glycan epitope. As used herein, the term "antibodies" is intended to include immunoglobulins and fragments thereof which are specifically reactive to the designated protein or peptide, or fragments thereof. Suitable antibodies include, but are not limited to, human antibodies, primatized antibodies, chimeric antibodies, bi-specific antibodies, humanized antibodies, conjugated antibodies (i.e., antibodies conjugated or fused to other proteins, radiolabels, cytotoxins), Small Modular ImmunoPharmaceuticals ("SMIPs™"), single chain antibodies, cameloid antibodies, and antibody fragments. As used herein, the term "antibodies" also includes intact monoclonal antibodies, polyclonal antibodies, single domain antibodies (e.g., shark single domain antibodies (e.g., IgNAR or fragments thereof)), multispecific antibodies (e.g. bi-specific antibodies) formed from at least two intact antibodies, and antibody fragments so long as they exhibit the desired biological activity. Antibody polypeptides for use herein may be of any type (e.g., IgA, IgD, IgE, IgG, IgM).

As used herein, an "antibody fragment" includes a portion of an intact antibody, such as, for example, the antigen-binding or variable region of an antibody. Examples of antibody fragments include Fab, Fab', F(ab')2, and Fv fragments; triabodies; tetrabodies; linear antibodies; single-chain antibody molecules; and multi specific antibodies formed from antibody fragments. The term "antibody fragment" also includes any synthetic or genetically engineered protein that acts like an antibody by binding to a specific antigen to form a complex. For example, antibody fragments include isolated fragments, "Fv" fragments, consisting of the variable regions of the heavy and light chains, recombinant single chain polypeptide molecules in which light and heavy chain variable regions are connected by a peptide linker ("ScFv proteins"), and minimal recognition units consisting of the amino acid residues that mimic the hypervariable region.

Antibodies can be generated using methods well known in the art. For example, protocols for antibody production are described by Harlow and Lane, 1988, *Antibodies: A Laboratory Manual*; incorporated herein by reference. Typically, antibodies can be generated in mouse, rat, guinea pig, hamster, camel, llama, shark, or other appropriate host. Alternatively, antibodies may be made in chickens, producing IgY molecules (Schade et al., 1996, *ALTEX* 13(5):80-85;

incorporated herein by reference). In some embodiments, antibodies suitable for the present invention are subhuman primate antibodies. For example, general techniques for raising therapeutically useful antibodies in baboons may be found, for example, in Goldenberg et al., international patent publication number WO 91/11465, 1991; and in Losman et al., 1990, *Int. J. Cancer* 46:310; both of which are incorporated herein by reference). In some embodiments, monoclonal antibodies may be prepared using hybridoma methods (Milstein and Cuello, 1983, *Nature* 305(5934):537-40; incorporated herein by reference). In some embodiments, monoclonal antibodies may also be made by recombinant methods (U.S. Pat. No. 4,166,452, 1979; incorporated herein by reference).

In some embodiments, antibodies suitable for the invention may include humanized or human antibodies. Humanized forms of non-human antibodies are chimeric Igs, Ig chains or fragments (such as Fv, Fab, Fab', F(ab')2 or other antigen-binding subsequences of Abs) that contain minimal sequence derived from non-human Ig. Generally, a humanized antibody has one or more amino acid residues introduced from a non-human source. These non-human amino acid residues are often referred to as "import" residues, which are typically taken from an "import" variable domain. Humanization is accomplished by substituting rodent complementarity determining regions (CDRs) or CDR sequences for the corresponding sequences of a human antibody (Riechmann et al., 1988, *Nature* 332(6162):323-7; Verhoeyen et al., 1988, *Science.* 239(4847):1534-6; both of which are incorporated herein by reference). Such "humanized" antibodies are chimeric Abs (U.S. Pat. No. 4,816,567, 1989; incorporated herein by reference), wherein substantially less than an intact human variable domain has been substituted by the corresponding sequence from a non-human species. In some embodiments, humanized antibodies are typically human antibodies in which some CDR residues and possibly some FR residues are substituted by residues from analogous sites in rodent Abs. Humanized antibodies include human Igs (recipient antibody) in which residues from a CDR of the recipient are replaced by residues from a CDR of a non-human species (donor antibody) such as mouse, rat or rabbit, having the desired specificity, affinity and capacity. In some instances, corresponding non-human residues replace Fv framework residues of the human Ig. Humanized antibodies may comprise residues that are found neither in the recipient antibody nor in the imported CDR or framework sequences. In general, the humanized antibody comprises substantially all of at least one, and typically two, variable domains, in which most if not all of the CDR regions correspond to those of a non-human Ig and most if not all of the FR regions are those of a human Ig consensus sequence. The humanized antibody optimally also comprises at least a portion of an Ig constant region (Fc), typically that of a human Ig (Riechmann et al., 1988, *Nature* 332(6162):323-7; Verhoeyen et al., 1988, *Science.* 239(4847):1534-6; both of which are incorporated herein by reference).

Human antibodies can also be produced using various techniques, including phage display libraries (Hoogenboom et al., 1991, *Mol Immunol.* 28(9):1027-37; Marks et al., 1991, *J Mol Biol.* 222(3):581-97; both of which are incorporated herein by reference) and the preparation of human monoclonal antibodies (Reisfeld and Sell, 1985, *Cancer Surv.* 4(1):271-90; incorporated herein by reference). Similarly, introducing human Ig genes into transgenic animals in which the endogenous Ig genes have been partially or completely inactivated can be exploited to synthesize human antibodies. Upon challenge, human antibody production is observed, which closely resembles that seen in humans in all respects, including gene rearrangement, assembly, and antibody repertoire (Fishwild et al., 1996, *Nat Biotechnol.* 14(7):845-51; Lonberg et al., 1994, *Nature* 368(6474):856-9; Lonberg and Huszar, 1995, *Int. Rev. Immunol.* 13(1):65-93; Marks et al., 1992, Biotechnology (N Y). 10(7):779-83; all of which are incorporated herein by reference).

Lectins

In some embodiments, binding agents provided in accordance with the present invention are lectins. Lectins are sugar-binding proteins which may bind to a soluble carbohydrate or to a carbohydrate moiety which is a part of a glycoconjugate (e.g., a glycopeptide or glycolipid). Lectins typically agglutinate certain animal cells and/or precipitate glycoconjugates by recognizing a particular sugar moiety. For example, SNA-1 is a lectin that has a high affinity for α2-6 sialic acids. As yet another example, polyporus squamosus lectins (PSL1a and PSL1b) have high affinity for binding sialylated glycoconjugates containing Neu5Acα2,6Galβ1,4Glc/GlcNAc trisaccharide sequences of asparagine-linked glycoproteins. Non-limiting exemplary lectins that may act as binding agents include SNA-1, SNA-1', PSL1a, PSL1b, and polypeptides derived therefrom.

Amino acid sequences of exemplary lectins are provided below:

```
Sambucus Nigra Lectin 1 (Genbank Accession No. U27122):
                                                     (SEQ ID NO: 56)
MRLVAKLLYLAVLAICGLGIHGALTHPRVTPPVYPSVSFNLTGADTYEPFLRALQEKVILGNHTA

FDLPVLNPESQVSDSNRFVLVPLTNPSGDTVTLAIDVVNLYVVAFSSNGKSYFFSGSTAVQRDNL

FVDTTQEELNFTGNYTSLERQVGFGRVYIPLGPKSLDQAISSLRTYTLTAGDTKPLARGLLVVIQ

MVSEAARFRYIELRIRTSITDASEFTPDLLMLSMENNWSSMSSEIQQAQPGGIFAGVVQLRDERN

NSIEVTNFRRLFELTYIAVLLYGCAPVTSSSYSNNAIDAQIIKMPVFRGGEYEKVCSVVEVTRRI

SGWDGLCVDVRYGHYIDGNPVQLRPCGNECNQLWTFRTDGTIRWLGKCLTASSSVMIYDCNTVPP

EATKWVVSIDGTITNPHSGLVLTAPQAAEGTALSLENNIHAARQGWTVGDVEPLVTFIVGYKQMC

LRENGENNFVWLEDCVLNRVQQEWALYGDGTIRVNSNRSLCVTSEDHEPSDLIVILKCEGSGNQR

WVFNTNGTISNPNAKLLMDVAQRDVSLRKIILYRPTGNPNQQWITTTHPA
```

-continued

Sambucus Nigra Lectin 1' (Genbank Accession No. U66191):

(SEQ ID NO: 57)

MKVVATILYLVVLAICGLGIHGAHPTHSAPPTVYPSVSFNLTEANSNEYRHFLQELRGKVILGSH

RAFDLPVLNPESKVSDSDRFVLVRLTNPSRKKVTLAIDVVTFYVVAFAQNDRSYFFSGSSEVQRE

NLFVDTTQEDLNFKGDYTSLEHQVGFGRVYIPLGPKSLAQSISSLSTYKSSAGDNKRLARSLLVV

IQMVSEAARFRYIQLRIQASITDAKEFTPDLLMLSMENKWSSMSSEIQQAQPGGAFAQVVKLLDQ

RNHPIDVTNFRRLFQLTSVAVLLHGCPTVTKMPAYIIKMPVFNGGEDEERCSVVEEVTRRIGGRD

GFCAEVKNGDEKDGTPVQLSSCGEQSNQQWTFSTDGTIQSLGKCLTTSSSVMIYNCKVVPPESTK

WVVSIDGTITNPRSGLVLTAPKAAEGTLVSLEKNVHAARQGWIVGNVEPLVTFIVGYEQMCLETN

PGNNDVSLGDCSVKSASKVDQKWALYGDGTIRVNNDRSLCVTSEGKSSNEPIIILKCLGWANQRW

VFNTDGTISNPDSKLVMHVDQNDVPLRKIILSHPSGTSNQQWIASTHPA

Polyporous squamosus lectin 1a (UniProt Q75WT9)

(SEQ ID NO: 58)

MSFQGHGIYYIASAYVANTRLALSEDSSANKSPDVIISSDAVDPLNNLWLIEPVGEADTYTVRNA

FAGSYMDLAGHAATDGTAIIGYRPTGGDNQKWIISQINDVWKIKSKETGTFVTLLNGDGGGTGTV

VGWQNITNNTSQNWTFQKLSQTGANVHATLLACPALRQDFKSYLSDGLYLVLTRDQISSIWQASG

LGSTPWRSEIFDCDDFATVFKGAVAKWGNENFKANGFALLCGLMFGSKSSGAHAYNWFVERGNFS

TVTFFEPQNGTYSANAWDYKAYFGLF

Polyporous squamosus lectin 1b (UniProt Q75WT8)

(SEQ ID NO: 59)

MSFEGHGIYHIPHAHVANIRMALANRGSGQNGTPVIAWDSNNDAFDHMWLVEPTGEADTYTIHNV

STGTYMDVTASAVADNTPIIGYQRTGNDNQKWIIRQVQTDGGDRPWKIQCKATGTFATLYSGGGS

GTAIVGWRLVNSNGNQDWVFQKLSQTSVNVHATLLACGATVGQDFKNYLYDGLYLVLPRDRISAI

WKASGLGETARRDGIYDSDEFAMTFKSAAATWGKENFKADGFAILCGMMFGTKASTNRHAYNWVV

ERGSFSTVTFFEPQNGTYSDDAWGYKAYFGLF

Aptamers

In some embodiments, binding agents provided in accordance with the present invention are aptamers. Aptamers are macromolecules composed of nucleic acid (e.g., RNA, DNA) that bind tightly to a specific molecular target (e.g., an umbrella topology glycan). A particular aptamer may be described by a linear nucleotide sequence and is typically about 15 to about 60 nucleotides in length. Without wishing to be bound by any theory, it is contemplated that the chain of nucleotides in an aptamer form intramolecular interactions that fold the molecule into a complex three-dimensional shape, and this three-dimensional shape allows the aptamer to bind tightly to the surface of its target molecule. Given the extraordinary diversity of molecular shapes that exist within the universe of all possible nucleotide sequences, aptamers may be obtained for a wide array of molecular targets, including proteins and small molecules. In addition to high specificity, aptamers have very high affinities for their targets (e.g., affinities in the picomolar to low nanomolar range for proteins). Aptamers are chemically stable and can be boiled or frozen without loss of activity. Because they are synthetic molecules, they are amenable to a variety of modifications, which can optimize their function for particular applications. For example, aptamers can be modified to dramatically reduce their sensitivity to degradation by enzymes in the blood for use in in vivo applications. In addition, aptamers can be modified to alter their biodistribution or plasma residence time.

Selection of aptamers that can bind umbrella topology glycans (and/or to umbrella topology glycan mimics) can be achieved through methods known in the art. For example, aptamers can be selected using the SELEX (Systematic Evolution of Ligands by Exponential Enrichment) method (Tuerk and Gold, 1990, *Science* 249:505-510; incorporated herein by reference). In the SELEX method, a large library of nucleic acid molecules (e.g., $10^{15}$ different molecules) is produced and/or screened with the target molecule (e.g., an umbrella topology glycan of umbrella topology glycan epitope). The target molecule is allowed to incubate with the library of nucleotide sequences for a period of time. Several methods, known in the art, can then be used to physically isolate the aptamer target molecules from the unbound molecules in the mixture, which can be discarded. The aptamers with the highest affinity for the target molecule can then be purified away from the target molecule and amplified enzymatically to produce a new library of molecules that is substantially enriched for aptamers that can bind the target molecule. The enriched library can then be used to initiate a new cycle of selection, partitioning, and amplification. After 5-15 cycles of this iterative selection, partitioning and amplification process, the library is reduced to a small number of aptamers that bind tightly to the target molecule. Individual molecules in the mixture can then be isolated, their nucleotide sequences determined, and their properties with respect to binding affinity and specificity measured and compared. Isolated aptamers can then be further refined to eliminate any nucleotides that do not contribute to target binding and/or aptamer structure, thereby producing aptamers truncated to their core binding domain. See Jayasena, 1999, *Clin. Chem.* 45:1628-50 for review of aptamer technology; the entire teachings of which are incorporated herein by reference).

Production of Polypeptides

Polypeptides in accordance with the invention (e.g., HA polypeptides and/or Non-HA polypeptides), and/or characteristic portions thereof, or nucleic acids encoding them, may be produced by any available means.

Polypeptides in accordance with the invention (or characteristic portions thereof) may be produced, for example, by utilizing a host cell system engineered to express a polypeptide-encoding nucleic acid in accordance with the invention.

Any system can be used to produce polypeptides (or characteristic portions), such as egg, baculovirus, plant, yeast, Madin-Darby Canine Kidney cells (MDCK), or Vero (African green monkey kidney) cells. Alternatively or additionally, polypeptides (or characteristic portions) can be expressed in cells using recombinant techniques, such as through the use of an expression vector (Sambrook et al., *Molecular Cloning: A Laboratory Manual*, CSHL Press, 1989; incorporated herein by reference).

Alternatively or additionally, polypeptides in accordance with the invention (or characteristic portions thereof) can be produced by synthetic means.

Alternatively or additionally, polypeptides in accordance with the invention (or characteristic portions thereof), and particularly HA polypeptides, may be produced in the context of intact virus, whether otherwise wild type, attenuated, killed, etc. Polypeptides in accordance with the invention (e.g., HA polypeptides), or characteristic portions thereof, may also be produced in the context of virus like particles.

In some embodiments, HA polypeptides (or characteristic portions thereof) can be isolated and/or purified from influenza virus. For example, virus may be grown in eggs, such as embryonated hen eggs, in which case the harvested material is typically allantoic fluid. Alternatively or additionally, influenza virus may be derived from any method using tissue culture to grow the virus. Suitable cell substrates for growing the virus include, for example, dog kidney cells such as MDCK or cells from a clone of MDCK, MDCK-like cells, monkey kidney cells such as AGMK cells including Vero cells, cultured epithelial cells as continuous cell lines, 293T cells, BK-21 cells, CV-1 cells, or any other mammalian cell type suitable for the production of influenza virus for vaccine purposes, readily available from commercial sources (e.g., ATCC, Rockville, Md.). Suitable cell substrates also include human cells such as MRC-5 cells. Suitable cell substrates are not limited to cell lines; for example primary cells such as chicken embryo fibroblasts are also included.

Also, it will be appreciated by those of ordinary skill in the art that polypeptides, and particularly variant HA polypeptides as described herein, may be generated, identified, isolated, and/or produced by culturing cells or organisms that produce the polypeptide (whether alone or as part of a complex, including as part of a virus particle or virus), under conditions that allow ready screening and/or selection of polypeptides capable of binding to umbrella-topology glycans. To give but one example, in some embodiments, it may be useful to produce and/or study a collection of polypeptides (e.g., HA variant polypeptides) under conditions that reveal and/or favor those variants that bind to umbrella topology glycans (e.g., with particular specificity and/or affinity). In some embodiments, such a collection of polypeptides (e.g., HA variant polypeptides) results from evolution in nature. In some embodiments, such a collection of polypeptides (e.g., HA variant polypeptides) results from engineering. In some embodiments, such a collection of polypeptides (e.g., HA variant polypeptides) results from a combination of engineering and natural evolution.

HA Receptors

HA interacts with the surface of cells by binding to a glycoprotein receptor. Binding of HA to HA receptors is predominantly mediated by N-linked glycans on the HA receptors. Specifically, HA on the surface of flu virus particles recognizes sialylated glycans that are associated with HA receptors on the surface of the cellular host. After recognition and binding, the host cell engulfs the viral cell and the virus is able to replicate and produce many more virus particles to be distributed to neighboring cells. Some crystal structures of exemplary HA-glycan interactions have been identified and are presented in Table 1:

TABLE 1

Crystal Structures of HA-Glycan Complexes

| Abbreviation (PDB ID) | Virus Strain | Glycan (with assigned coordinates) |
| --- | --- | --- |
| ADkALB76_H1_26 (2WRH) | A/duck/Alberta/76 (H1N1) | Neu5Ac |
| ASI30_H1_23 (1RV0) | A/Swine/Iowa/30 (H1N1) | Neu5Ac |
| ASI30_H1_26 (1RVT) | A/Swine/Iowa/30 (H1N1) | Neu5Acα6Galβ4GlcNAcβ3Galβ4Glc |
| ASC18_H1_26 (2WRG) | A/South Carolina/1/18 (H1N1) | Neu5Acα6Galβ4GlcNAcβ3Gal |
| APR34_H1_23 (1RVX) | A/Puerto Rico/8/34 (H1N1) | Neu5Acα3Galβ4GlcNAc |
| APR34_H1_26 (1RVZ) | A/Puerto Rico/8/34 (H1N1) | Neu5Acα6Galβ4GlcNAc |
| ACkNY91_H2_23 (2WR2) | A/chicken/NY/29878/91 (H2N2) | Neu5Acα3Galβ3GlcNAc |
| AckNY91_H2_26 (2WR1) | A/chicken/NY/29878/91 (H2N2) | Neu5Acα6Galβ4GlcNAc |
| AdkON77_H2_23 (2WR3) | A/duck/Ontario/77 (H2N2) | Neu5Acα3Galβ4GlcNAc |
| AdkON77_H2_26 (2WR4) | A/duck/Ontario/77 (H2N2) | Neu5Acα6Galβ4GlcNAc |
| AckPD84_H2_26 (2WRF) | A/chicken/Potsdam/475/84 (H2N2) | Neu5Acα6Gal |
| ASING57_H2_23 (2WRB) | A/Singapore/1/57 (H2N2) | Neu5Ac |
| ASING57_H2_26 (2WR7) | A/Singapore/1/57 (H2N2) | Neu5Acα6Galβ4GlcNAcβ3Gal |
| AJAP57_H2_26(2WRE) | A/Japan/305/57 (H2N2) | Neu5Acα6Gal |
| ADU63_H3_23 (1MQM) | A/Duck/Ukraine/1/63 (H3N8) | Neu5Acα3Gal |
| ADU63_H3_26 (1MQN) | A/Duck/Ukraine/1/63 (H3N8) | Neu5Acα6Gal |
| AAI68_H3_23 (1HGG) | A/Aichi/2/68 (H3N2) | Neu5Acα3Galβ4Glc |
| ADS97_H5_23 (1JSN) | A/Duck/Singapore/3/97 (H5N3) | Neu5Acα3Galβ3GlcNAc |
| ADS97_H5_26(1JSO) | A/Duck/Singapore/3/97 (H5N3) | Neu5Ac |
| Viet1203_04_H5 (2FK0) | A/Vietnam/1203/2004 (H5N1) | |
| Viet1194_04_H5 (2IBX) | A/Vietnam/1194/2004 (H5N1) | |
| ASI30_H1_23 (1RV0) | A/Swine/Iowa/30 (H1N1) | Neu5Ac |

TABLE 1-continued

Crystal Structures of HA-Glycan Complexes

| Abbreviation (PDB ID) | Virus Strain | Glycan (with assigned coordinates) |
|---|---|---|
| ASI30_H1_26 (1RVT) | A/Swine/Iowa/30 (H1N1) | Neu5Acα6Galβ4GlcNAcβ3Galβ4Glc |
| APR34_H1_23 (1RVX) | A/Puerto Rico/8/34 (H1N1) | Neu5Acα3Galβ4GlcNAc |
| APR34_H1_26 (1RVZ) | A/Puerto Rico/8/34 (H1N1) | Neu5Acα6Galβ4GlcNAc |
| ADU63_H3_23 (1MQM) | A/Duck/Ukraine/1/63 (H3N8) | Neu5Acα3Gal |
| ADU63_H3_26 (1MQN) | A/Duck/Ukraine/1/63 (H3N8) | Neu5Acα6Gal |
| AAI68_H3_23 (1HGG) | A/Aichi/2/68 (H3N2) | Neu5Acα3Galβ4Glc |
| ADS97_H5_23 (1JSN) | A/Duck/Singapore/3/97 (H5N3) | Neu5Acα3Galβ3GlcNAc |
| ADS97_H5_26(1JSO) | A/Duck/Singapore/3/97 (H5N3) | Neu5Ac |
| Viet04_H5 (2FK0) | A/Vietnam/1203/2004 (H5N1) | |

HA-α2-6 sialylated glycan complexes were generated by superimposition of the CA trace of the HA1 subunit of ADU63_H3 and ADS97_H5 and Viet04_H5 on ASI30_H1_26 and APR34_H1_26 (H1). Although the structural complexes of the human A/Aichi/2/68 (H3N2) with α2-6 sialylated glycans are published (Eisen et al., 1997, *Virology*, 232:19; incorporated herein by reference), their coordinates were not available in the Protein Data Bank. The SARF2 program (available through the world wide web at 123d.ncifcrf.gov/sarf2 was used to obtain the structural alignment of the different HA1 subunits for superimposition.

HA receptors are modified by either α2-3 or α2-6 sialylated glycans near the receptor's HA-binding site, and the type of linkage of the receptor-bound glycan can affect the conformation of the receptor's HA-binding site, thus affecting the receptor's specificity for different HAs.

For example, the glycan binding pocket of avian HA is narrow. According to the present invention, this pocket binds to the trans conformation of α2-3 sialylated glycans, and/or to cone-topology glycans, whether α2-3 or α2-6 linked.

HA receptors in avian tissues, and also in human deep lung and gastrointestinal (GI) tract tissues are characterized by α2-3 sialylated glycan linkages, and furthermore (according to the present invention), are characterized by glycans, including α2-3 sialylated and/or α2-6 sialylated glycans, which predominantly adopt cone topologies. HA receptors having such cone-topology glycans may be referred to herein as CTHArs.

By contrast, human HA receptors in the bronchus and trachea of the upper respiratory tract are modified by α2-6 sialylated glycans. Unlike the α2-3 motif, the α2-6 motif has an additional degree of conformational freedom due to the C6-C5 bond (Russell et al., 2006, *Glycoconj J* 23:85; incorporated herein by reference). HAs that bind to such α2-6 sialylated glycans have a more open binding pocket to accommodate the diversity of structures arising from this conformational freedom. Moreover, according to the present invention, HAs may need to bind to glycans (e.g., α2-6 sialylated glycans) in an umbrella topology, and particularly may need to bind to such umbrella topology glycans with strong affinity and/or specificity, in order to effectively mediate infection of human upper respiratory tract tissues. HA receptors having umbrella-topology glycans may be referred to herein as UTHArs.

As a result of these spatially restricted glycosylation profiles, humans are not usually infected by viruses containing many wild type avian HAs (e.g., avian H5). Specifically, because the portions of the human respiratory tract that are most likely to encounter virus (i.e., the trachea and bronchi) lack receptors with cone glycans (e.g., α2-3 sialylated glycans, and/or short glycans) and wild type avian HAs typically bind primarily or exclusively to receptors associated with cone glycans (e.g., α2-3 sialylated glycans, and/or short glycans), humans rarely become infected with avian viruses. Only when in sufficiently close contact with virus that it can access the deep lung and/or gastrointestinal tract receptors having umbrella glycans (e.g., long α2-6 sialylated glycans) do humans become infected.

Glycan Arrays

To rapidly expand the current knowledge of known specific glycan-glycan binding protein (GBP) interactions, the Consortium for Functional Glycomics (CFG; available through the world wide web at functionalglycomics.org), an international collaborative research initiative, has developed glycan arrays comprising several glycan structures that have enabled high throughput screening of GBPs for novel glycan ligand specificities. The glycan arrays comprise both monovalent and polyvalent glycan motifs (i.e. attached to polyacrylamide backbone), and each array comprises 264 glycans with low (10 μM) and high (100 μM) concentrations, and six spots for each concentration (see the world wide web at functionalglycomics.org/static/consortium/resources/resourcecoreh5).

The arrays predominantly comprise synthetic glycans that capture the physiological diversity of N- and O-linked glycans. In addition to the synthetic glycans, N-linked glycan mixtures derived from different mammalian glycoproteins are also represented on the array.

As used herein, a glycan "array" refers to a set of one or more glycans, optionally immobilized on a solid support. In some embodiments, an "array" is a collection of glycans present as an organized arrangement or pattern at two or more locations that are physically separated in space. Typically, a glycan array will have at least 4, at least 8, at least 16, at least 24, at least 48, at least 96, or several hundred or thousand discrete locations. In general, glycan arrays in accordance with the invention may have any of a variety of formats. Various different array formats applicable to biomolecules are known in the art. For example, a huge number of protein and/or nucleic acid arrays are well known. Those of ordinary skill in the art will immediately appreciate standard array formats appropriate for glycan arrays of the present invention.

In some embodiments, glycan arrays in accordance with the invention are present in "microarray" formats. A microarray may typically have sample locations separated by a distance of about 50 t to about 200 t or less and immobilized sample in the nano to micromolar range or nano to picogram range. Array formats known in the art include, for example, those in which each discrete sample location has a scale of, for example, ten μ.

In some embodiments, glycan arrays in accordance with the invention comprise a plurality of glycans spatially immobilized on a support. The present invention provides glycan molecules arrayed on a support. As used herein, "support" refers to any material which is suitable to be used to array glycan molecules. As will be appreciated by those of ordinary skill in the art, any of a wide variety of materials may be employed. To give but a few examples, support materials which may be of use in the invention include hydrophobic membranes, for example, nitrocellulose, PVDF or nylon membranes. Such membranes are well known in the art and can be obtained from, for example, Bio-Rad, Hemel Hempstead, UK.

In some embodiments, the support on which glycans are arrayed may comprise a metal oxide. Suitable metal oxides include, but are not limited to, titanium oxide, tantalum oxide, and aluminum oxide. Examples of such materials may be obtained from Sigma-Aldrich Company Ltd, Fancy Road, Poole, Dorset. BH12 4QH UK.

In some embodiments, such a support is or comprises a metal oxide gel. A metal oxide gel is considered to provide a large surface area within a given macroscopic area to aid immobilization of the carbohydrate-containing molecules.

Additional or alternative support materials which may be used in accordance with the present invention include gels, for example silica gels or aluminum oxide gels. Examples of such materials may be obtained from, for example, Merck KGaA, Darmstadt, Germany.

In some embodiments, glycan arrays are immobilized on a support that can resist change in size or shape during normal use. For example a support may be a glass slide coated with a component material suitable to be used to array glycans. Also, some composite materials can desirable provide solidity to a support.

As demonstrated herein, arrays in accordance with the invention are useful for the identification and/or characterization of different HA polypeptides and their binding characteristics. In some embodiments, HA polypeptides in accordance with the invention are tested on such arrays to assess their ability to bind to umbrella topology glycans (e.g., to α2-6 sialylated glycans, and particularly to long α2-6 sialylated glycans arranged in an umbrella topology).

Indeed, the present invention provides arrays of α2-6 sialylated glycans, and optionally α2-3 sialylated glycans, that can be used to characterize HA polypeptide binding capabilities and/or as a diagnostic to detect, for example, human-binding HA polypeptides. In some embodiments, arrays in accordance with the invention contain glycans (e.g., α2-6 sialylated glycans, and particularly long α2-6 sialylated glycans) in an umbrella topology. As will be clear to those of ordinary skill in the art, such arrays are useful for characterizing or detecting any HA polypeptides, including for example, those found in natural influenza isolates in addition to those designed and/or prepared by researchers.

In some embodiments, such arrays include glycans representative of about 10%, about 15%, about 20%, about 25%, about 30% about 35%, about 40%, about 45%, about 50%, about 55%, about 60%, about 65%, about 70%, about 75%, about 80%, about 85%, about 90% about 95%, or more of the glycans (e.g., the umbrella glycans, which will often be α2-6 sialylated glycans, particularly long α2-6 sialylated glycans) found on human HA receptors, and particularly on human upper respiratory tract HA receptors. In some embodiments, arrays in accordance with the invention include some or all of the glycan structures depicted in FIG. 10 In some embodiments, arrays include at least about 10%, about 15%, about 20%, about 25%, about 30% about 35%, about 40%, about 45%, about 50%, about 55%, about 60%, about 65%, about 70%, about 75%, about 80%, about 85%, about 90%, about 95%, or more of these depicted glycans.

The present invention provides methods for identifying or characterizing HA proteins using glycan arrays. In some embodiments, for example, such methods comprise steps of (1) providing a sample containing HA polypeptide, (2) contacting the sample with a glycan array comprising, and (3) detecting binding of HA polypeptide to one or more glycans on the array.

Suitable sources for samples containing HA polypeptides to be contacted with glycan arrays according to the present invention include, but are not limited to, pathological samples, such as blood, serum/plasma, peripheral blood mononuclear cells/peripheral blood lymphocytes (PBMC/PBL), sputum, urine, feces, throat swabs, dermal lesion swabs, cerebrospinal fluids, cervical smears, pus samples, food matrices, and tissues from various parts of the body such as brain, spleen, and liver. Alternatively or additionally, other suitable sources for samples containing HA polypeptides include, but are not limited to, environmental samples such as soil, water, and flora. Yet other samples include laboratory samples, for example of engineered HA polypeptides designed and/or prepared by researchers. Other samples that have not been listed may also be applicable.

A wide variety of detection systems suitable for assaying HA polypeptide binding to glycan arrays in accordance with the invention are known in the art. For example, HA polypeptides can be detectably labeled (directly or indirectly) prior to or after being contacted with the array; binding can then be detected by detection of localized label. In some embodiments, scanning devices can be utilized to examine particular locations on an array.

Alternatively or additionally, binding to arrayed glycans can be measured using, for example, calorimetric, fluorescence, or radioactive detection systems, or other labeling methods, or other methods that do not require labeling. In general, fluorescent detection typically involves directly probing the array with a fluorescent molecule and monitoring fluorescent signals. Alternatively or additionally, arrays can be probed with a molecule that is tagged (for example, with biotin) for indirect fluorescence detection (in this case, by testing for binding of fluorescently-labeled streptavidin). Alternatively or additionally, fluorescence quenching methods can be utilized in which the arrayed glycans are fluorescently labeled and probed with a test molecule (which may or may not be labeled with a different fluorophore). In such embodiments, binding to the array acts to squelch the fluorescence emitted from the arrayed glycan, therefore binding is detected by loss of fluorescent emission. Alternatively or additionally, arrayed glycans can be probed with a live tissue sample that has been grown in the presence of a radioactive substance, yielding a radioactively labeled probe. Binding in such embodiments can be detected by measuring radioactive emission.

Such methods are useful to determine the fact of binding and/or the extent of binding by HA polypeptides to glycan arrays in accordance with the invention. In some embodiments, such methods can further be used to identify and/or characterize agents that interfere with or otherwise alter glycan-HA polypeptide interactions.

Methods described below may be of particular use in, for example, identifying whether a molecule thought to be capable of interacting with a carbohydrate can actually do so, or to identify whether a molecule unexpectedly has the capability of interacting with a carbohydrate.

The present invention also provides methods of using arrays in accordance with the invention, for example, to detect a particular agent in a test sample. For instance, such methods may comprise steps of (1) contacting a glycan array with a test sample (e.g., with a sample thought to contain an HA polypeptide); and, (2) detecting the binding of any agent in the test sample to the array.

Yet further, binding to arrays in accordance with the invention may be utilized, for example, to determine kinetics of interaction between binding agent and glycan. For example, methods in accordance with the invention for determining interaction kinetics may include steps of (1) contacting a glycan array with the molecule being tested; and, (2) measuring kinetics of interaction between the binding agent and arrayed glycan(s).

The kinetics of interaction of a binding agent with any of the glycans in an array in accordance with the invention can be measured by real time changes in, for example, colorimetric or fluorescent signals, as detailed above. Such methods may be of particular use in, for example, determining whether a particular binding agent is able to interact with a specific carbohydrate with a higher degree of binding than does a different binding agent interacting with the same carbohydrate.

It will be appreciated, of course, that glycan binding by HA polypeptides in accordance with the invention can be evaluated on glycan samples or sources not present in an array format per se. For example, HA polypeptides in accordance with the invention can be bound to tissue samples and/or cell lines to assess their glycan binding characteristics. Appropriate cell lines include, for example, any of a variety of mammalian cell lines, particularly those expressing HA receptors containing umbrella topology glycans (e.g., at least some of which may be α2-6 sialylated glycans, and particularly long α2-6 sialylated glycans). In some embodiments, utilized cell lines express individual glycans with umbrella topology. In some embodiments, utilized cell lines express a diversity of glycans. In some embodiments, cell lines are obtained from clinical isolates; in some they are maintained or manipulated to have a desired glycan distribution and/or prevalence. In some embodiments, tissue samples and/or cell lines express glycans characteristic of mammalian upper respiratory epithelial cells.

Nucleic Acids

In some embodiments, the present invention provides nucleic acids which encode an HA polypeptide or a characteristic or biologically active portion of an HA polypeptide. In some embodiments, the invention provides nucleic acids which are complementary to nucleic acids which encode an HA polypeptide or a characteristic or biologically active portion of an HA polypeptide.

In some embodiments, the invention provides nucleic acid molecules which hybridize to nucleic acids encoding an HA polypeptide or a characteristic or biologically active portion of an HA polypeptide. Such nucleic acids can be used, for example, as primers or as probes. To give but a few examples, such nucleic acids can be used as primers in polymerase chain reaction (PCR), as probes for hybridization (including in situ hybridization), and/or as primers for reverse transcription-PCR (RT-PCR).

In some embodiments, nucleic acids can be DNA or RNA, and can be single stranded or double-stranded. In some embodiments, nucleic acids in accordance with the invention may include one or more non-natural nucleotides; in some embodiments, nucleic acids in accordance with the invention include only natural nucleotides.

Antibodies to Polypeptides

The present invention provides antibodies to binding agent polypeptides in accordance with the invention (e.g., HA polypeptides). These may be monoclonal or polyclonal and may be prepared by any of a variety of techniques known to those of ordinary skill in the art (e.g., see Harlow and Lane, 1988, *Antibodies: A Laboratory Manual*, Cold Spring Harbor Laboratory; incorporated herein by reference). For example, antibodies can be produced by cell culture techniques, including the generation of monoclonal antibodies, or via transfection of antibody genes into suitable bacterial or mammalian cell hosts, in order to allow for the production of recombinant antibodies.

Testing Binding Agents in Animal Models

The present invention provides methods for testing binding agents in accordance with the invention (e.g., HA polypeptides, LSBAs, USBAs, UTSBAs, etc.) in an animal host. As used herein, an "animal host" includes any animal model suitable for influenza research. For example, animal hosts suitable for the invention can be any mammalian hosts, including primates, ferrets, cats, dogs, cows, horses, rodents such as, mice, hamsters, rabbits, and rats. In some embodiments, an animal host used for the invention is a ferret. In particular, in some embodiments, an animal host is naïve to viral exposure or infection prior to administration of a binding agent in accordance with the invention (optionally in a composition in accordance with the invention). In some embodiments, the animal host is inoculated with, infected with, or otherwise exposed to virus prior to or concurrent with administration of a binding agent in accordance with the invention. An animal host used in the practice of the present invention can be innoculated with, infected with, or otherwise exposed to virus by any method known in the art. In some embodiments, an animal host may be innoculated with, infected with, or exposed to virus intranasally.

In some embodiments, a suitable animal host may have a similar distribution of umbrella vs. cone topology glycans and/or α2-6 glycans vs. a 2-3 glycans to the distribution found in the human respiratory tract. For example, it is contemplated that a ferret as an animal host may be more representative than a mouse when used as model of disease caused by influenza viruses in humans (Tumpey et al., 2007, *Science* 315; 655-59; incorporated herein by reference). Without wishing to be bound any theories, the present invention encompasses the idea that ferrets may have a more similar distribution of glycans in the respiratory tract to those in the human respiratory tract than mouse does to human.

Naïve and/or innoculated animals may be used for any of a variety of studies. For example, such animal models may be used for virus transmission studies as in known in the art. It is contemplated that the use of ferrets in virus transmission studies may serve as a reliable predictor for virus transmission in humans. For example, air transmission of viral influenza from innoculated animals (e.g., ferrets) to naïve animals is known in the art (Tumpey et al., 2007, *Science* 315; 655-59; incorporated herein by reference). Virus transmission studies may be used to test binding agent polypeptides in accordance with the invention (e.g., HA polypeptides). For example, binding agents in accordance with the invention may be administered to a suitable animal host before, during or after virus transmission studies in order to determine the efficacy of said binding agent in blocking virus binding and/or infectivity in the animal host. Using information gathered from virus transmission studies in an animal host, one may predict the efficacy of a binding agent in blocking virus binding and/or infectivity in a human host.

Pharmaceutical Compositions

In some embodiments, the present invention provides for pharmaceutical compositions including binding agents in accordance with the invention (e.g., HA polypeptides, LSBAs, UTBAs, UTBSAs, etc.) and/or related entities. For example, in some embodiments, binding agent polypeptide(s) (e.g., HA polypeptides), nucleic acids encoding such polypeptides, characteristic or biologically active fragments of such polypeptides or nucleic acids, antibodies that bind to and/or compete with such polypeptides or fragments, small molecules that interact with or compete with such polypeptides or with glycans that bind to them, etc. are included in pharmaceutical compositions in accordance with the invention.

The invention encompasses treatment of influenza infections by administration of such pharmaceutical compositions in accordance with the invention. In some embodiments, pharmaceutical compositions in accordance with the invention are administered to a subject suffering from or susceptible to an influenza infection. In some embodiments, a subject is considered to be suffering from an influenza infection in the subject is displaying one or more symptoms commonly associated with influenza infection. In some embodiments, the subject is known or believed to have been exposed to the influenza virus. In some embodiments, a subject is considered to be susceptible to an influenza infection if the subject is known or believed to have been exposed to the influenza virus. In some embodiments, a subject is known or believed to have been exposed to the influenza virus if the subject has been in contact with other individuals known or suspected to have been infected with the influenza virus and/or if the subject is or has been present in a location in which influenza infection is known or thought to be prevalent.

In some embodiments, subjects suffering from or susceptible to influenza infection are tested for antibodies to binding agents in accordance with the invention prior to, during, or after administration of pharmaceutical compositions in accordance with the invention. In some embodiments, subjects having such antibodies are not administered pharmaceutical compositions comprising binding agents in accordance with the invention. In some embodiments, an appropriate dose of pharmaceutical composition and/or binding agent is selected based on detection (or lack thereof) of such antibodies.

In some embodiments, selection of a particular subject for treatment, particular binding agent or composition for administration, and/or particular dose or regimen for administration, is memorialized, for example in a written, printed, or electronic storage form.

Compositions in accordance with the invention may be administered prior to or after development of one or more symptoms of influenza infection.

The invention encompasses treatment of influenza infections by administration of compounds described herein. In some embodiments, treatment of influenza infections according to the present invention is accomplished by administration of a vaccine. To date, although significant accomplishments have been made in the development of influenza vaccines, there is room for further improvement. The present invention provides vaccines comprising binding agents in accordance with the invention (e.g., HA polypeptides, LSBAs, UTBAs, UTBSAs, etc.), and particularly comprising binding agents that bind to umbrella glycans (e.g., α2-6 linked umbrella glycans such as, for example, long α2-6 sialylated glycans).

To give but one example, attempts to generate vaccines specific for the H5N1 strain in humans have generally not been successful due, at least in part, to low immunogenicity of H5 HAs. In one study, a vaccine directed at the H5N1 strain was shown to yield antibody titers of 1:40, which is not a titer high enough to guarantee protection from infection. Furthermore, the dosage required to generate even a modest 1:40 antibody titer (two doses of 90 μg of purified killed virus or antigen) was 12-times that normally used in the case of the common seasonal influenza virus vaccine (Treanor et al., 2006, *N Eng J Med,* 354:1343; incorporated herein by reference). Other studies have similarly shown that current H5 vaccines are not highly immunogenic (Bresson et al., 2006, *Lancet,* 367:1657; incorporated herein by reference). In some embodiments, vaccines in accordance with the invention are formulated utilizing one or more strategies (see, for example, Enserink, 2005, *Science,* 309:996; incorporated herein by reference) intended to allow use of lower dose of H5 HA protein, and/or to achieve higher immunogenicity. For example, in some embodiments, multivalency is improved (e.g., via use of dendrimers); in some embodiments, one or more adjuvants is utilized, etc.

In some embodiments, the present invention provides for vaccines and the administration of these vaccines to a human subject. In some embodiments, vaccines are compositions comprising one or more of the following: (1) inactivated virus, (2) live attenuated influenza virus, for example, replication-defective virus, (3) binding agent in accordance with the invention (e.g., HA polypeptides, LSBAs, UTBAs, UTBSAs, etc.), (4) nucleic acid encoding binding agent polypeptide (e.g., HA polypeptide) or characteristic or biologically active portion thereof, (5) DNA vector that encodes binding agent polypeptide in accordance with the invention (e.g., HA polypeptide) or characteristic or biologically active portion thereof, and/or (6) expression system, for example, cells expressing one or more influenza proteins to be used as antigens.

Thus, in some embodiments, the present invention provides inactivated flu vaccines. In some embodiments, inactivated flu vaccines comprise one of three types of antigen preparation: inactivated whole virus, sub-virions where purified virus particles are disrupted with detergents or other reagents to solubilize the lipid envelope ("split" vaccine) or purified HA polypeptide ("subunit" vaccine). In some embodiments, virus can be inactivated by treatment with formaldehyde, beta-propiolactone, ether, ether with detergent (such as TWEEN-80®), cetyl trimethyl ammonium bromide (CTAB) and Triton N101, sodium deoxycholate and tri(n-butyl) phosphate. Inactivation can occur after or prior to clarification of allantoic fluid (from virus produced in eggs); the virions are isolated and purified by centrifugation (Nicholson et al., eds., 1998, *Textbook of Influenza,* Blackwell Science, Malden, Mass.; incorporated herein by reference). To assess the potency of the vaccine, the single radial immunodiffusion (SRD) test can be used (Schild et al., 1975, *Bull. World Health Organ.,* 52:43-50 & 223-31; Mostow et al., 1975, *J. Clin. Microbiol.,* 2:531; both of which are incorporated herein by reference).

The present invention also provides live, attenuated flu vaccines, and methods for attenuation are well known in the art. In some embodiments, attenuation is achieved through the use of reverse genetics, such as site-directed mutagenesis.

In some embodiments, influenza virus for use in vaccines is grown in eggs, for example, in embryonated hen eggs, in which case the harvested material is allantoic fluid. Alternatively or additionally, influenza virus may be derived from any method using tissue culture to grow the virus. Suitable cell substrates for growing the virus include, for example, dog kidney cells such as MDCK or cells from a clone of MDCK, MDCK-like cells, monkey kidney cells such as AGMK cells including Vero cells, cultured epithelial cells as continuous cell lines, 293T cells, BK-21 cells, CV-1 cells, or any other mammalian cell type suitable for the production of influenza virus (including upper airway epithelial cells) for vaccine purposes, readily available from commercial sources (e.g., ATCC, Rockville, Md.). Suitable cell substrates also include human cells such as MRC-5 cells. Suitable cell substrates are not limited to cell lines; for example primary cells such as chicken embryo fibroblasts are also included.

In some embodiments, vaccines in accordance with the invention further comprise one or more adjuvants. For example, aluminum salts (Baylor et al., 2002, *Vaccine*, 20:S18; incorporated herein by reference) and monophosphoryl lipid A (MPL; Ribi et al., 1986, *Immunology and Immunopharmacology of Bacterial Endotoxins*, Plenum Publ. Corp., NY, p. 407; incorporated herein by reference) can be used as adjuvants in human vaccines. Alternatively or additionally, new compounds are currently being tested as adjuvants in human vaccines, such as MF59 (Chiron Corp., available through the world wide web at chiron.com/investors/pressreleases/2005/051028, CPG 7909 (Cooper et al., 2004, *Vaccine*, 22:3136; incorporated herein by reference), and saponins, such as QS21 (Ghochikyan et al., 2006, *Vaccine*, 24:2275; incorporated herein by reference).

Additionally, some adjuvants are known in the art to enhance the immunogenicity of influenza vaccines, such as poly[di(carboxylatophenoxy)phosphazene] (PCCP; Payne et al., 1998, *Vaccine*, 16:92; incorporated herein by reference), interferon-γ (Cao et al., 1992, *Vaccine*, 10:238; incorporated herein by reference), block copolymer P1205 (CRL1005; Katz et al., 2000, *Vaccine*, 18:2177; incorporated herein by reference), interleukin-2 (IL-2; Mbwuike et al., 1990, *Vaccine*, 8:347; incorporated herein by reference), and polymethyl methacrylate (PMMA; Kreuter et al., 1981, *J. Pharm. Sci.*, 70:367; incorporated herein by reference).

In some embodiments, compositions in accordance with the invention, e.g., compositions of binding agents, do not include adjuvants (e.g., provided compositions are essentially free of adjuvants). In some embodiments, compositions in accordance with the invention do not include an alum adjuvant (e.g., provided compositions are essentially free of alum).

In addition to vaccines, the present invention provides other therapeutic compositions useful in the treatment of viral infections. In some embodiments, treatment is accomplished by administration of an agent that interferes with expression or activity of an HA polypeptide.

In some embodiments, the present invention provides pharmaceutical compositions comprising antibodies or other agents related to provided polypeptides. For example, the invention provides compositions containing antibodies recognize virus particles containing a particular HA polypeptide (e.g., an HA polypeptide that binds to umbrella glycans), nucleic acids (such as nucleic acid sequences complementary to HA sequences, which can be used for RNAi), glycans that compete for binding to HA receptors, small molecules or glycomimetics that compete the glycan-HA polypeptide interaction, or any combination thereof. In some embodiments, collections of different agents, having diverse structures are utilized. In some embodiments, therapeutic compositions comprise one or more multivalent agents. In some embodiments, treatment comprises urgent administration shortly after exposure or suspicion of exposure.

In some embodiments, any of the vaccines described herein offer broad cross-protection against different varieties of influenza viruses. For example, in some embodiments, vaccines described herein offer cross-protection against both avian and human-adapted H5 viruses. In some embodiments, any of the vaccines described herein offer cross-protection against any H5 influenza virus strain or variant. In some embodiments, any of the vaccines described herein offer cross-protection against any H2 influenza virus strain or variant. In some embodiments, any of the vaccines described herein offer cross-protection against any H1, H2, H3, H4, H5, H6, H7, H8, H9, H10, H11, H12, H13, H14, H15, or H16 influenza virus strain or variant.

In general, a pharmaceutical composition will include a therapeutic agent in addition to one or more inactive agents such as a sterile, biocompatible carrier including, but not limited to, sterile water, saline, buffered saline, or dextrose solution. Alternatively or additionally, the composition can contain any of a variety of additives, such as stabilizers, buffers, excipients (e.g., sugars, amino acids, etc.), or preservatives.

In some embodiments, the therapeutic agent present in a pharmaceutical composition in accordance with the invention will consist of one or more binding agents as described herein. In some embodiments, a pharmaceutical composition in accordance with the invention contains a binding agent (e.g., an HA polypeptide, LSBA, UTBA, UTSBA, etc.) that binds to umbrella topology glycans (and/or to umbrella topology glycan mimics). In some such embodiments, the composition in accordance with the invention is substantially free of related agents (e.g., of other HA polypeptides, etc.) that do not bind to umbrella-topology glycans. In some such embodiments, pharmaceutical compositions in accordance with the invention contains not more than 50%, 40%, 30%, 20%, 10%, 5%, or 1% of an agent that binds to HA receptor glycans other than umbrella topology glycans.

In some embodiments, a pharmaceutical composition will include a therapeutic agent that is encapsulated, trapped, or bound within a lipid vesicle, a bioavailable and/or biocompatible and/or biodegradable matrix, or other microparticle.

In some embodiments, a provided pharmaceutical composition will include a binding agent (e.g., an HA polypeptide, LSBA, UTBA, UTSBA, etc.) that is not aggregated. For example, in some embodiments, less than 1%, 2%, 5%, 10%, 20%, or 30%, by dry weight or number, of the binding agent is present in an aggregate.

In some embodiments, a provided pharmaceutical composition will include a binding agent (e.g., an HA polypeptide, LSBA, UTBA, UTSBA, etc.) that is not denatured. For example, in some embodiments, less than 1%, 2%, 5%, 10%, 20%, or 30%, by dry weight or number, of the UTSBA administered is denatured.

In some embodiments, a provided pharmaceutical composition will include a binding agent (e.g., an HA polypeptide, LSBA, UTBA, UTSBA, etc.) that is not inactive. For example, in some embodiments, less than 1%, 2%, 5%, 10%, 20%, or 30%, by dry weight or number, of the UTSBA administered is inactive.

In some embodiments, pharmaceutical compositions in accordance with the invention are formulated to reduce immunogenicity of provided binding agents. For example, in some embodiments, a provided binding agent is associated with (e.g., bound to) an agent, such as polyethylene glycol and/or carboxymethyl cellulose, that masks its immunogenicity. In some embodiments, a provided binding agent has additional glycosylation that reduces immunogenicity.

Pharmaceutical compositions of the present invention may be administered either alone or in combination with one or more other therapeutic agents including, but not limited to, vaccines and/or antibodies. By "in combination with," it is not intended to imply that the agents must be administered at the same time or formulated for delivery together, although these methods of delivery are within the scope of the invention. In general, each agent will be administered at a dose and on a time schedule determined for that agent. Additionally, the invention encompasses the delivery of pharmaceutical compositions in accordance with the invention in combination with agents that may improve their bioavailability, reduce or modify their metabolism, inhibit their excretion, or modify their distribution within the body. Although the pharmaceutical compositions of the present invention can be used for treatment of any subject (e.g., any animal) in need thereof, they are most preferably used in the treatment of humans. In some embodiments, pharmaceutical compositions in accordance with the invention and/or binding agents are administered in combination with one or more of an anti-viral agent (e.g., Oseltamivir [TAMIFLU®], Zanamavir [RELEZA®], etc.) and/or a sialidase.

Pharmaceutical compositions of the present invention can be administered by a variety of routes, including oral, intravenous, intramuscular, intra-arterial, subcutaneous, intraventricular, transdermal, interdermal, rectal, intravaginal, intraperitoneal, topical (as by powders, ointments, creams, or drops), mucosal, nasal, buccal, enteral, sublingual; by intratracheal instillation, bronchial instillation, and/or inhalation; and/or as an oral spray, nasal spray, and/or aerosol. In general the most appropriate route of administration will depend upon a variety of factors including the nature of the agent (e.g., its stability in the environment of the gastrointestinal tract), the condition of the patient (e.g., whether the patient is able to tolerate oral administration), etc.

At present the oral or nasal spray or aerosol route (e.g., by inhalation) is most commonly used to deliver therapeutic agents directly to the lungs and respiratory system. However, the invention encompasses the delivery of the pharmaceutical composition in accordance with the invention by any appropriate route taking into consideration likely advances in the sciences of drug delivery.

In some embodiments, preparations for inhaled or aerosol delivery comprise a plurality of particles. In some embodiments, such preparations have a mean particle size of about 1, about 2, about 3, about 4, about 5, about 6, about 7, about 8, about 9, about 10, about 11, about 12, or about 13 microns. In some embodiments, preparations for inhaled or aerosol delivery are formulated as a dry powder. In some embodiments, preparations for inhaled or aerosol delivery are formulated as a wet powder, for example through inclusion of a wetting agent. In some embodiments, the wetting agent is selected from the group consisting of water, saline, or other liquid of physiological pH.

In some embodiments, compositions in accordance with the invention are administered as drops to the nasal or buccal cavity. In some embodiments, a dose may comprise a plurality of drops (e.g., 1-100, 1-50, 1-20, 1-10, 1-5, etc.)

In some embodiments, compositions in accordance with the invention are administered using a device that delivers a metered dosage of composition (e.g., of binding agent).

Suitable devices for use in delivering intradermal pharmaceutical compositions described herein include short needle devices such as those described in U.S. Pat. No. 4,886,499, U.S. Pat. No. 5,190,521, U.S. Pat. No. 5,328,483, U.S. Pat. No. 5,527,288, U.S. Pat. No. 4,270,537, U.S. Pat. No. 5,015,235, U.S. Pat. No. 5,141,496, U.S. Pat. No. 5,417,662 (all of which are incorporated herein by reference). Intradermal compositions may also be administered by devices which limit the effective penetration length of a needle into the skin, such as those described in WO99/34850, incorporated herein by reference, and functional equivalents thereof. Also suitable are jet injection devices which deliver liquid vaccines to the dermis via a liquid jet injector or via a needle which pierces the stratum corneum and produces a jet which reaches the dermis. Jet injection devices are described for example in U.S. Pat. No. 5,480,381, U.S. Pat. No. 5,599,302, U.S. Pat. No. 5,334,144, U.S. Pat. No. 5,993,412, U.S. Pat. No. 5,649,912, U.S. Pat. No. 5,569,189, U.S. Pat. No. 5,704,911, U.S. Pat. No. 5,383,851, U.S. Pat. No. 5,893,397, U.S. Pat. No. 5,466,220, U.S. Pat. No. 5,339,163, U.S. Pat. No. 5,312,335, U.S. Pat. No. 5,503,627, U.S. Pat. No. 5,064,413, U.S. Pat. No. 5,520,639, U.S. Pat. No. 4,596,556, U.S. Pat. No. 4,790,824, U.S. Pat. No. 4,941,880, U.S. Pat. No. 4,940,460, WO 97/37705, and WO 97/13537 (all of which are incorporated herein by reference). Also suitable are ballistic powder/particle delivery devices which use compressed gas to accelerate vaccine in powder form through the outer layers of the skin to the dermis. Additionally, conventional syringes may be used in the classical mantoux method of intradermal administration.

General considerations in the formulation and manufacture of pharmaceutical agents may be found, for example, in *Remington's Pharmaceutical Sciences*, 19$^{th}$ ed., Mack Publishing Co., Easton, Pa., 1995; incorporated herein by reference.

Pharmaceutical compositions in accordance with the invention may be administered in any dose appropriate to achieve a desired outcome. In some embodiments, the desired outcome is reduction in intensity, severity, and/or frequency, and/or delay of onset of one or more symptoms of influenza infection.

In some embodiments, pharmaceutical compositions in accordance with the invention are formulated to administer a dose of binding agent effective to compete with influenza HA for binding to umbrella topology glycans. In some embodiments, such binding by influenza HA is reduced after administration of one or more doses of a composition in accordance with the invention as compared with its level absent such administration. In some embodiments, pharmaceutical compositions in accordance with the invention are formulated to administer a dose of binding agent effective to saturate at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or more HA binding sites (e.g., HA binding sites containing umbrella topology glycans) present in the subject (e.g., in the respiratory tract of the subject) receiving the composition.

In some embodiments, pharmaceutical compositions in accordance with the invention are formulated to deliver a unit dose of binding agent within the range of 0.0001 to 1000 mg/kg.

In some embodiments, pharmaceutical compositions in accordance with the invention are administered in multiple doses. In some embodiments, pharmaceutical compositions in accordance with the invention are administered in multiple doses/day. In some embodiments, pharmaceutical compositions in accordance with the invention are administered according to a continuous dosing regimen, such that the subject does not undergo periods of less than therapeutic dosing interposed between periods of therapeutic dosing. In some embodiments, pharmaceutical compositions in accordance with the invention are administered according to an intermittent dosing regimen, such that the subject undergoes at least one period of less than therapeutic dosing interposed between two periods of therapeutic dosing.

Diagnostics/Kits

The present invention provides kits for detecting binding agents (e.g., HA polypeptides, LSBAs, UTBAs, UTSBAs, etc), and particular for detecting binding agents with particular glycan binding characteristics (e.g., binding to umbrella glycans, to α2-6 sialylated glycans, to long α2-6 sialylated glycans, etc.) in pathological samples, including, but not limited to, blood, serum/plasma, peripheral blood mononuclear cells/peripheral blood lymphocytes (PBMC/PBL), sputum, urine, feces, throat swabs, dermal lesion swabs, cerebrospinal fluids, cervical smears, pus samples, food matrices, and tissues from various parts of the body such as brain, spleen, and liver. The present invention also provides kits for detecting binding agents (e.g., HA polypeptides, LSBAs, UTBAs, UTSBAs, etc) of interest in environmental samples, including, but not limited to, soil, water, and flora. Other samples that have not been listed may also be applicable.

In some embodiments, the present invention provides kits for detecting HA polypeptides as described herein whether or not such polypeptides are binding agents.

In some embodiments, kits in accordance with the invention may include one or more agents that specifically detect binding agents (e.g., HA polypeptides, LSBAs, UTBAs, UTSBAs, etc) with particular glycan binding characteristics. Such detecting agents may include, for example, antibodies that specifically recognize certain binding agents (e.g., binding agents that bind to umbrella glycans and/or to α2-6 sialylated glycans and/or to long α2-6 sialylated glycans), which can be used to specifically detect such binding agents by ELISA, immunofluorescence, and/or immunoblotting.

Antibodies that bind to HA polypeptides can also be used in virus neutralization tests, in which a sample is treated with antibody specific to HA polypeptides of interest, and tested for its ability to infect cultured cells relative to untreated sample. If the virus in that sample contains such HA polypeptides, the antibody will neutralize the virus and prevent it from infecting the cultured cells. Alternatively or additionally, such antibodies can also be used in HA-inhibition tests, in which the HA protein is isolated from a given sample, treated with antibody specific to a particular HA polypeptide or set of HA polypeptides, and tested for its ability to agglutinate erythrocytes relative to untreated sample. If the virus in the sample contains such an HA polypeptide, the antibody will neutralize the activity of the HA polypeptide and prevent it from agglutinating erythrocytes (Harlow & Lane, 1988, *Antibodies: A Laboratory Manual*, CSHL Press; available through the world wide web at who.int/csr/resources/publications/influenza/WHO_CDS_CSR_NCS_2002_5/en/index and who.int/csr/disease/avian_influenza/guidelines/labtests/en/index). In some embodiments, such agents may include nucleic acids that specifically bind to nucleotides that encode particular HA polypeptides and that can be used to specifically detect such HA polypeptides by RT-PCR or in situ hybridization (available through the world wide web at who.int/csr/resources/publications/influenza/WHO_CDS_CSR_NCS_2002_5/en/index and who.int/csr/disease/avian_influenza/guidelines/labtests/en/index). In some embodiments, nucleic acids which have been isolated from a sample are amplified prior to detection. In some embodiments, diagnostic reagents can be detectably labeled.

The present invention also provides kits containing reagents according to the invention for the generation of influenza viruses and vaccines. Contents of the kits include, but are not limited to, expression plasmids containing HA nucleotides (or characteristic or biologically active portions) encoding HA polypeptides of interest (or characteristic or biologically active portions). Alternatively or additionally, kits may contain expression plasmids that express HA polypeptides of interest (or characteristic or biologically active portions). Expression plasmids containing no virus genes may also be included so that users are capable of incorporating HA nucleotides from any influenza virus of interest. Mammalian cell lines may also be included with the kits, including but not limited to, Vero and MDCK cell lines. In some embodiments, diagnostic reagents can be detectably labeled.

In some embodiments, kits for use in accordance with the present invention may include, a reference sample, instructions for processing samples, performing the test, instructions for interpreting the results, buffers and/or other reagents necessary for performing the test. In some embodiments the kit can comprise a panel of antibodies.

In some embodiments of the present invention, glycan arrays, as discussed above, may be utilized as diagnostics and/or kits.

In some embodiments, glycan arrays and/or kits in accordance with the invention are used to perform dose response studies to assess binding of HA polypeptides to umbrella glycans at multiple doses (e.g., as described herein). Such studies give particularly valuable insight into the binding characteristics of tested HA polypeptides, and are particularly useful to assess specific binding. Dose response binding studies of this type find many useful applications. To give but one example, they can be helpful in tracking the evolution of binding characteristics in a related series of HA polypeptide variants, whether the series is generated through natural evolution, intentional engineering, or a combination of the two.

In some embodiments, glycan arrays and/or kits in accordance with the invention are used to induce, identify, and/or select binding agents (e.g., HA polypeptides, and/or HA polypeptide variants) having desired binding characteristics. For instance, in some embodiments, glycan arrays and/or kits in accordance with the invention are used to exert evolutionary (e.g., screening and/or selection) pressure on a population of polypeptide binding agents (e.g., HA polypeptides).

The present invention provides kits for administration of pharmaceutical compositions in accordance with the invention. For example, in some embodiments, the invention provides a kit comprising at least one dose of a binding agent. In some embodiments, the invention provides a kit comprising an initial unit dose and a subsequent unit dose of a binding agent. In some such embodiments, the initial unit dose is greater than the subsequent unit dose or wherein the two doses are equal.

In some embodiments, kits in accordance with the invention (particularly those for administration of pharmaceutical compositions in accordance with the invention) comprise at least one component of a delivery device, e.g., an inhaler. In some such embodiments, the invention provides a kit comprising at least one component of a delivery device, e.g., an inhaler and a dose of a binding agent.

In some embodiments, provided kits comprise instructions for use.

EXEMPLIFICATION

Example 1: Identification of Molecular Determinants of Broad Spectrum Human Binding HA Polypeptides Introduction The H5N1 avian influenza virus ("bird flu" or "avian flu") is a highly infectious and deadly pathogen. Since 1996, several H5N1 outbreaks have occurred across three continents killing millions of poultry. Since its emergence, the virus has also shown potential to infect humans with a mortality rate exceeding 60%. Humans have virtually no immunity to the H5N1 virus, but this virus has not yet adapted to the human host to be able to efficiently infect and transmit between humans. The virus would acquire mutations that allow it to gain a foothold in the human population.

Hemagglutinin (HA), the surface glycoprotein of influenza A virus, is responsible for initiating viral entry into the host cell. HA binds to sialylated glycan receptors (complex glycans terminated by α2→3 or α2→6-linked sialic acid). The H5N1 HA preferentially binds to glycan receptors terminated by α2→3 linked sialic acid. The present inventors have demonstrated that the glycan receptors in the human host for human-adapted influenza A viruses are α2→6 sialylated glycans that adopt a characteristic umbrella-like topology (referred to henceforth as human receptors) in the glycan receptor-binding site (RBS) of HA (Chandrasekharan et al., 2008, *Nat Biotech*, 26:107; incorporated herein by reference). The present inventors have also shown that high affinity binding to these human glycan receptors is a characteristic of human adapted HA and correlates with the efficient airborne transmissibility of the human-adapted H1N1 and H3N2 viruses (Chandrasekharan et al., 2008, *Nat Biotech*, 26:107; Srinivasan et al., 2008, *PNAS*, 105: 2800; both of which are incorporated herein by reference. In the present study, the present inventors have provided an H5N1 virus in which HA has sequence substitutions in the RBS that allow it to bind with high affinity to human receptors.

Experimental Design

Influenza HA is a homotrimeric protein, wherein a monomer contains 552 amino acids. Each monomer is composed of two disulphide-linked moieties, HA1 and HA2. HA1 comprises the glycan-receptor binding site (RBS), whereas HA2 is involved in the fusion of the viral and cellular membranes. The RBS pocket involves HA positions 95, 131, 133, 136, 137, 138, 145, 153, 155, 156, 158, 159, 183, 186, 187, 189, 190, 192, 193, 194, 195, 196, 219, 222, 224, 225, 226, 227, 228 (H3 numbering used).

The present inventors have conducted a detailed analysis of molecular contacts between H5N1 and a representative human receptor and have compared these contacts with those between the human-adapted pandemic H1N1, H2N2 and H3N2 HAs and human receptors. Through this approach, the present inventors have defined strategies for generating mutant forms of H5N1 HA. The mutations Q226L and G228S (or LS) have been introduced across several genetic clades of H5N1 HA. These mutations are based on the characteristic amino acid substitutions at the 226 and 228 positions of H2N2 and H3N2 HAs that have led to their human adaptation, respectively.

Figure 13:
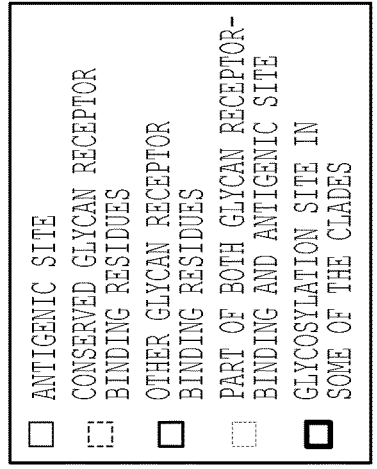
FIG. 13: Comparison of RBS of H5N1 HAs across different genetic clades. A/Hong Kong/486/97, Genetic Clade 0 (HK_486_97_c0) (SEQ ID NO: 76); A/Duck/Hunan/795/02, Genetic Clade 2.1.1 (DK_Hunan_795_02_c.2.1.1) (SEQ ID NO: 77); A/Hong Kong/213/03, Genetic Clade 1 (Hk_213_03_c1) (SEQ ID NO: 78); A/Vietnam/1194/04, Genetic Clade 1 (Viet_1194_04_c1) (SEQ ID NO: 79); A/Vietnam/1203/04, Genetic Clade 1 (Viet_1203_04_c1) (SEQ ID NO: 80); A/Indonesia/5/05, Genetic Clade 2.1.3 (Ind_5_05_c2.1.3) (SEQ ID NO: 81); A/Anhui/1/05, Genetic Clade 2.3.4 (Anhui_1_05_c2.3.4) (SEQ ID NO: 82); A/Egypt/2786-NAMRU3/06, Genetic Clade 2.2 (Egypt_2876-N3_06_c2.2) (SEQ ID NO: 83); A/goose/Guiyang/337/06, Genetic Clade 4 (Go_Guiy_337_06_c4) (SEQ ID NO: 84); A/Egypt/2321-NAMRU3/07, Genetic Clade 2.2.1 (Egypt_2321-N3_07_c2.2.1) (SEQ ID NO: 85); A/Egypt/3300-NAMRU3/08, Genetic Clade 2.2.1 (Egypt 3300-N3_08_c.2.2.1) (SEQ ID NO: 86); A/common magpie/Hong Kong/5052/07, Genetic Clade 2.3.2 (Mag_HK_5052_07_c.2.3.2) (SEQ ID NO: 87); A/Chicken/Vietnam/NCVD-016/2008, Genetic Clade 7 (Ck_Viet_NCVD-016_08_c7) (SEQ ID NO: 88).
Figure 14:
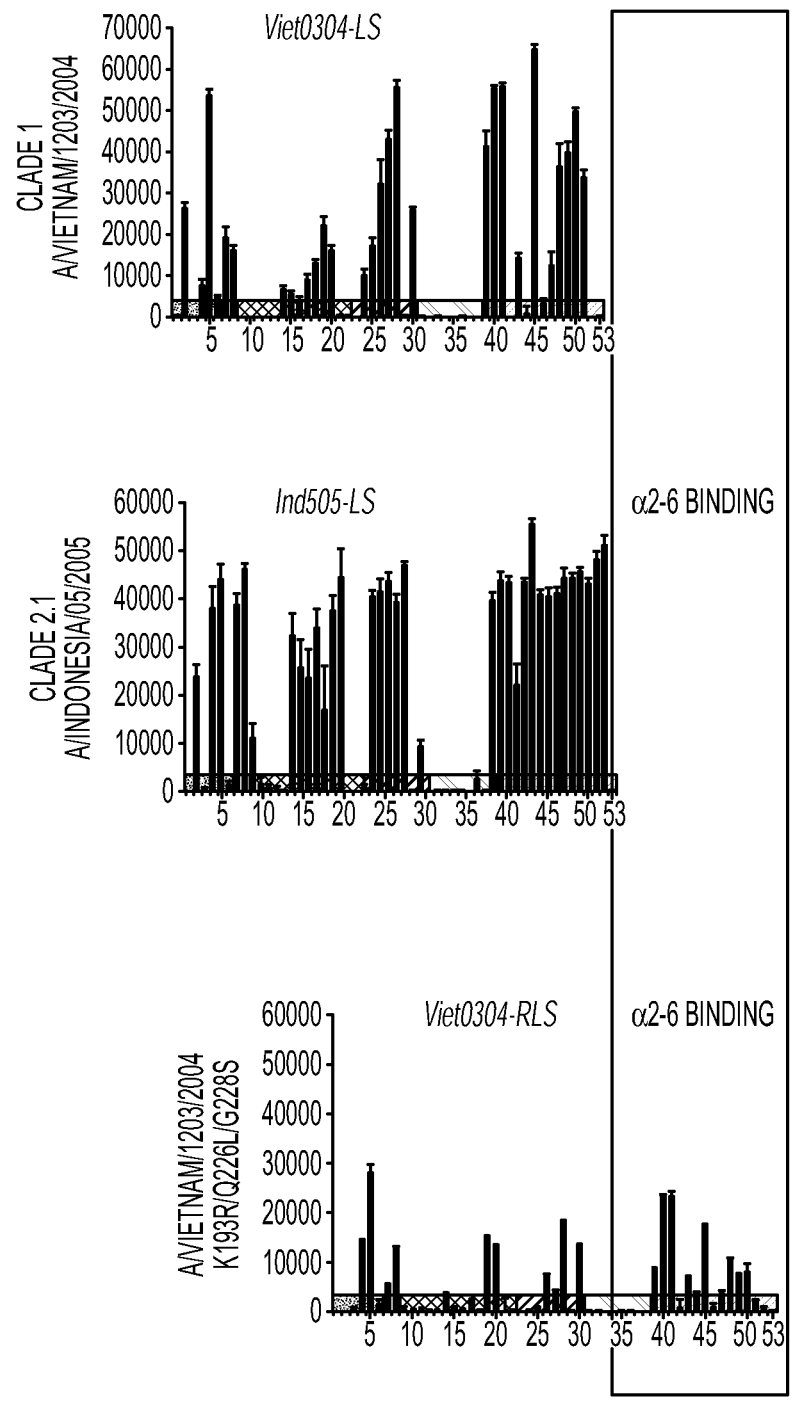
FIG. 14: Adapted from Stevens et al., 2008, *J. Mol. Biol.*, 381:1382-94. Viet0304: A/Vietnam/1203/04. Ind505: A/Indonesia/5/05. LS: Q226L and G228S mutations RBS of HA.

These mutations have been introduced in the context of the RBS of different genetic clades of H5N1 HA (FIG. 13). Previous studies (e.g., Stevens et al., 2008, *J. Mol. Biol.*, 381:1382-94; and Stevens et al., 2006, *Science*, 312:404; both of which are incorporated herein by reference) have analyzed both recombinant HA and whole viruses comprising the LS mutations in different H5N1 strains on glycan array platforms and have shown that some of these strains have acquired binding to α2→6 sialylated glycans (FIG. 14). However, the goal of these studies was to screen for binding at high protein concentration or viral titers to determine how many α2→3 or α2→6 glycans showed binding signals.

In contrast, the present inventors performed a dose-dependent analysis on recombinant HAs carrying the LS mutation in the RBS from several H5N1 strains (FIG. 15). The present data demonstrate that none of these mutants showed the characteristic high binding affinity to human receptors that is shared by human-adapted HAs. The present results also correlated with the inefficient transmission of H5N1 viruses carrying just the LS mutation in the RBS. However, none of these mutants showed high affinity human receptor binding. Therefore additional strategies were needed to define mutant forms of H5N1 HA.

Mutations that Abrogate Glycosylation

Thus, the present inventors introduced 5 amino acid substitutions at 128, 133, 145, 159, 193 (bold and underlined residues below) into the Viet_1203_04_c1 (A/Viet Nam/1203/04 which is a clade 1 strain) HA in order to make its RBS similar to that of the more recent genetic clades (which includes strains such as A/Indonesia/5/05).

The present inventors recognized that glycosylation at amino acid position N158 might interfere with the umbrella-like topology of human receptor in the RBS of H5N1 HA. Thus, the inventors' first strategy involved generating mutant forms of H5N1 HA that contained Q228L and/or G228S substitutions and an additional T160A mutation that abrogates glycosylation at N158.

This glycosylation site is not conserved across all genetic clades. If the absence of glycosylation at N158 improves human receptor binding of H5N1 HA with LS mutations, then the LS mutations alone might suffice to achieve human adaptation of viruses belonging to genetic clades that naturally lack this glycosylation site (c2.2, c2.2.1, etc.; see FIG. 13). The template sequence for these clades was chosen as Egypt_2876-N3_06_c2.2 (A/Egypt/2786-N3/06 belonging to clade 2.2). The present inventors have also defined mutant forms that carry the Q226L mutation alone (in the context of deglycosylation at 158 position) to check the extent of improvement of the human receptor binding affinity, given that in H2 HA, the Q226L mutation is sufficient to substantially improve the affinity.

Figure 16:
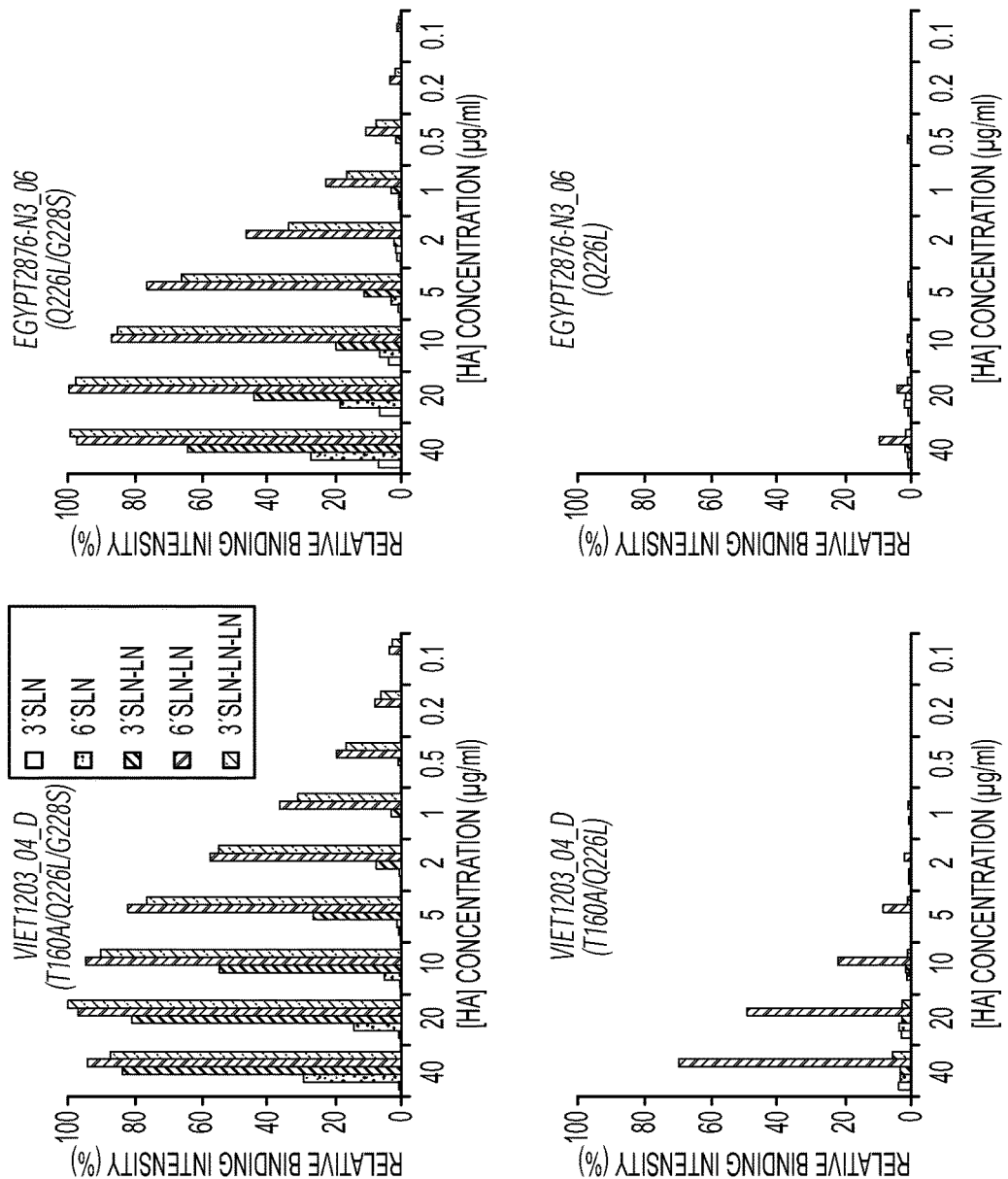
FIG. 16: Dose dependent analysis of H5N1 HAs that lack glycosylation at N158 in the context of LS mutation. Removal of glycosylation at N158 in the context of LS mutation increased human receptor binding affinity to the same range (Kd'~20 pM) as observed for human adapted H1N1 and H2N2 HAs. Removal of glycosylation at N158 on H5 HA template with Q226L mutation alone (i.e., without G228S of the LS mutation) showed improved preference to human receptors (over avian receptors), but substantially lowered human receptor-binding affinity in comparison with N158-deglycosylated LS mutant.

Dose-dependent analysis of the above mutants (FIG. 16) showed that removing the glycosylation at Asn-158 by mutating Thr-160→Ala in the context of LS mutation substantially improves binding to human receptors. This was observed for both the T160A/Q226L/G228S mutant on Viet1203_04_D as well as LS mutation on Egypt_2876-N3_06_c2.2 HA. The present inventors further demonstrated that the Q226L mutation alone (without G228S) is not sufficient to provide the high human receptor-binding affinity in the context of the removal of glycosylation at N158. The present invention, however, encompasses the recognition that a mutation at Q226 (e.g., Q226L) alone might suffice to provide the high human receptor-binding affinity in the context of the removal of glycosylation at N158 in the context of some particular virus strains. The present invention also encompasses the recognition that a mutation at G228 (e.g., G228S) alone might suffice to provide the high human receptor-binding affinity in the context of the removal of glycosylation at N158 in the context of some particular virus strains. The present invention also encompasses the recognition that mutations at both Q226 and G228 (e.g., Q226L and G228S) might be required to provide the high human receptor-binding affinity in the context of the removal of glycosylation at N158 in the context of some particular virus strains.

In addition, the inventors discovered that binding of the above mutants to avian receptors (particularly to 3'SLN-LN-LN and 3'SLN-LN) was also quite high, which is not typical of human adapted HAs. For example, even in the case of the prototypic pandemic H2N2 HA (A/Albany/6/58) which showed both human and avian receptor binding, the human receptor binding affinity was orders of magnitude higher than that of avian receptor-binding affinity.

Amino Acid Deletion in the Loop Region

Figure 17:
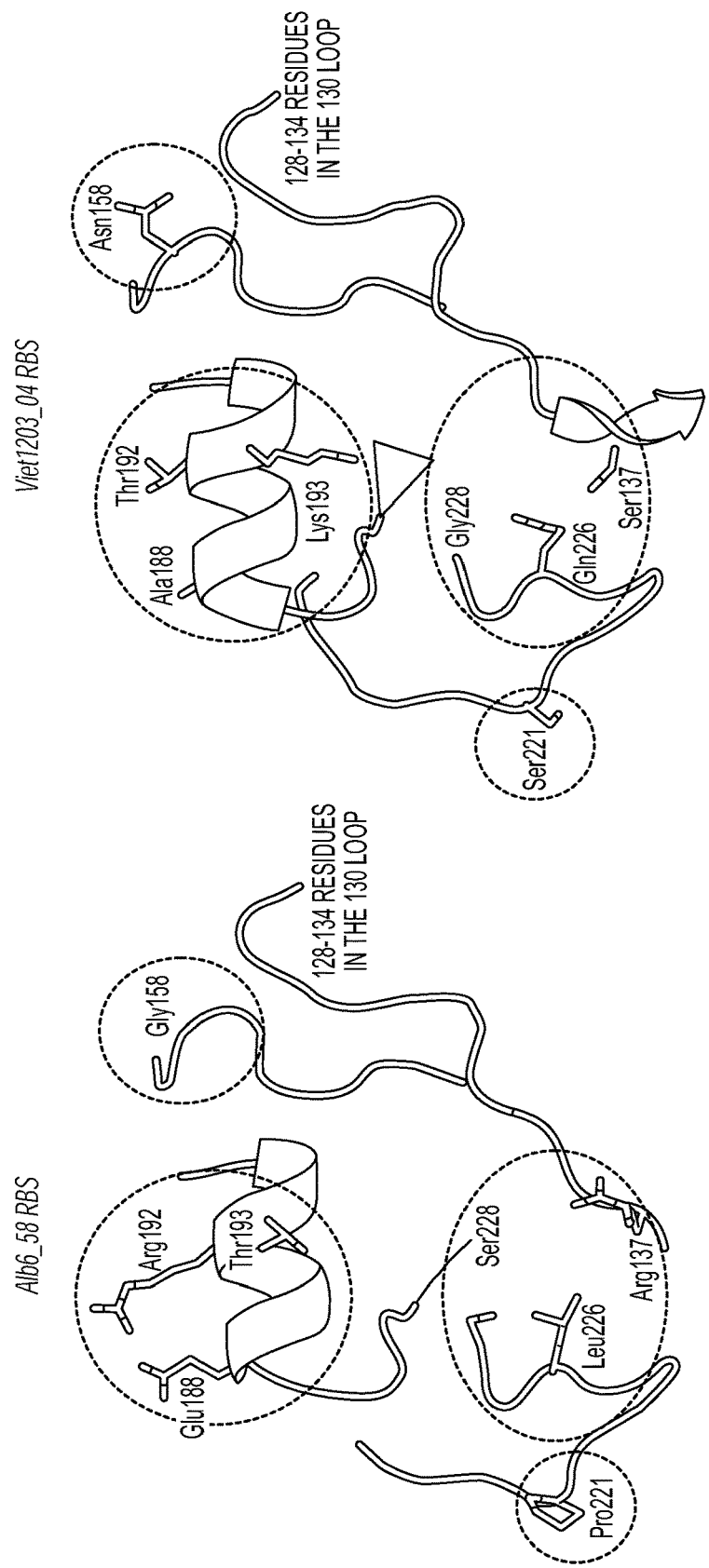
FIG. 17: Comparing salient features of RBS between human adapted H2N2 HA (Alb6_58) and H5N1 (Viet1203_04) HA. Four differences in H2N2 HA as compared with H5N1 HA include: (1) Composition of 130 loop in H2N2 HA which includes a deletion, (2) lack of glycosylation at 158 position in H2N2 HA, (3) amino acid composition of the base of the RBS involving positions 137, 221, 226 and 228, and (4) amino acid composition at top of the RBS involving positions 188, 192 and 193.

The present inventors have designed mutant forms of H5N1 HA such that the molecular contacts between its RBS and human receptor closely mimics that of contacts between human-adapted H2N2 HAs and human receptors. Based on the inventors' previous work in understanding the molecular composition of the RBS of H2N2 HA and how it governs glycan receptor specificity, the inventors first performed a detailed molecular comparison of the RBS of H5N1 HA with that of a prototypic human-adapted H2N2 HA from a 1957-58 pandemic strain (A/Albany/6//58 or Alb6_58) (FIG. 17). In order to minimize the differences in the molecular composition of RBS between H5 HA and Alb6_58 HA, the inventors generated a mutant on the Viet1203_04_D template ("Viet203_04_D_H2RBS"; SEQ ID NO: 61) that comprised 13 amino acid substitutions at 131, 132, 133, 135, 137, 155, 188, 192, 193, 221, 226, 227, and 228, and a deletion at 130. The present study, for the very first time, focuses on design and testing of mutations in the H5N1 HA RBS that represent a combination of deletion and substitutions based on a comprehensive comparison between H2 and H5 HA. The deletion was made at position 130. Although H2N2 HA lacks glycosylation at 158 position, the N158 glycosylation site (of Viet1203_04_D) in the mutant HA was retained. Thus, the present invention encompasses the recognition that mutations that abrogate glycosylation at the 158 site in addition to the aforementioned mutations might enhance human binding even further. The present inventors also designed another version of this mutant ("Viet203_04_D_H2RBSmin"; SEQ ID NO: 63) with fewer mutations based on conservative substitutions.

The present inventors also searched for HA sequences from other H5N1 strains which might naturally be closer to Alb6_58 H2N2 HA in terms of molecular composition of the RBS. The inventors identified two sets of exemplary templates: (1) with the switch in charge properties of positions 192 and 193 (A/chicken/Vietnam/NCVD-093/2008 or ckViet_08), and (2) with a deletion in the 130 loop (A/chicken/Egypt/R2/2007 or ckEgy_07). Additional mutant forms with fewer mutations in the above-mentioned positions on these new H5N1 HA templates were designed to make the H5N1 HA RBS mimic that of human-adapted H2N2 HA RBS.

Figure 19:
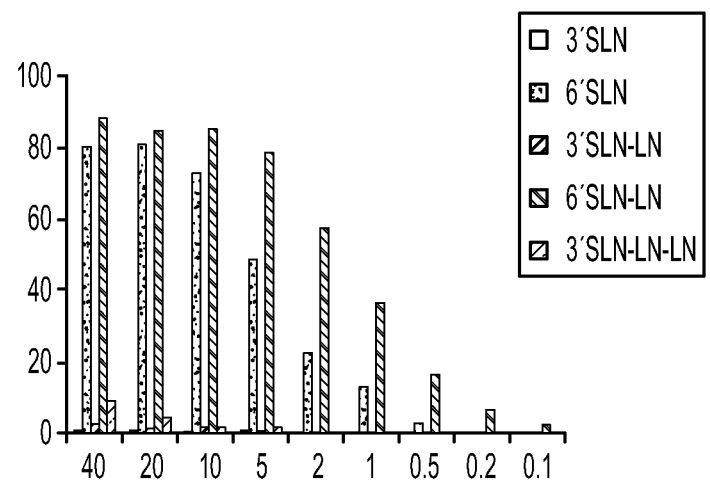
FIG. 19: Dose dependent analysis of mutant of H5N1 HA (Viet1203_04_D_H2RBS) designed such that the molecular composition of its RBS mimics that of human-adapted H2N2 HA. This mutant shows highly specific high affinity binding to human receptors that is characteristic of other human adapted HAs. The binding affinity of this mutant to human receptor (6'SLN-LN) is quantified by Kd'~3 pM that is in the same range as that of human adapted H1N1 and H2N2 HAs.

Mutant human-receptor binding affinity using dose-dependent glycan array were tested. The Viet1203_04_D_H2RBS mutant showed highly specific high affinity binding to human receptors that is characteristic of human adapted H1N1 and H2N2 HAs (FIG. 19). The present invention encompasses the recognition that additional mutations can be designed to understand the relationship between (1) the 130 loop composition and deletion, (2) switch in the charged residues at the 192 and 193 positions, and (3) glycosylation at 158 position and how this relationship governs the human receptor binding affinity of the mutant H5N1 HAs.

Exemplary Sequences of H5N1 Templates Used and Exemplary Mutant Polypeptides Designed in Accordance with the Above Principles and the Principles Set Forth in Example 2

An alignment of exemplary H5N1 templates and exemplary mutant H5 HA polypeptides designed in accordance with the above principles and the principles set forth in Example 2 are presented in FIG. 18 and below:

```
                                                        (SEQ ID NO: 60)
Viet1203_04_D: bold, underlined residues denote substitution sites
MEKIVLLFAIVSLVKSDQICIGYHANNSTEQVDTIMEKNVTVTHAQDILEKKHNGKLCDLDGVK

PLILRDCSVAGWLLGNPMCDEFINVPEWSYIVEKANPVNDLCYPGDFNDYEELKHLLSRINHFE

KIQIIPKSSWSDHEASSGVSSACPYQGKPSFFRNVVWLIKKNNTYPTIKRSYNNTNQEDLLVLW

GIHHPNDAAEQTRLYQNPTTYISVGTSTLNQRLVPRIATRSKVNGQSGRMEFFWTILKPNDAIN

FESNGNFIAPEYAYKIVKKGDSTIMKSELEYGNCNTKCQTPMGAINSSMPFHNIHPLTIGECPK

YVKSNRLVLATGLRNSPQRERRRKKRGLFGAIAGFIEGGWQGMVDGWYGYHHSNEQGSGYAADK

ESTQKAIDGVTNKVNSIIDKMNTQFEAVGREFNNLERRIENLNKKMEDGFLDVWTYNAELLVLM

ENERTLDFHDSNVKNLYDKVRLQLRDNAKELGNGCFEFYHKCDNECMESVRNGTYDYPQYSEEA

RLKREEISGVKLESIGIYQILSIYSTVASSLALAIMVAGLSLWMCSNGSLQCRICI
```

In the following sequences, italics and highlighting denote the region where the mutations are made, and boldface and underlining indicate the residues that were mutated.

```
Viet1203_04_D_H2RBS:
                                                         (SEQ ID NO: 61)
MEKIVLLFAIVSLVKSDQICIGYHANNSTEQVDTIMEKNVTVTHAQDILEKKHNGKLCDLDGVK

PLILRDCSVAGWLLGNPMCDEFINVPEWSYIVEKANPVNDLCYPGDFNDYEELKHLLSRINHFE
```

KIQIIPKSSWSDH TTTGGSRACPYQGKPSFFRNVV WLTKKNNTYPTIKRSYNNTNQEDLLVLW

GIHHPNDEAEQRALYQNPTTYISVGTSTLNQRLVPRIATRPKVNGLGSRMEFFWTILKPNDAIN

FESNGNFIAPEYAYKIVKKGDSTIMKSELEYGNCNTKCQTPMGAINSSMPFHNIHPLTIGECPK

YVKSNRLVLATGLRNSPQRERRRKKRGLFGAIAGFIEGGWQGMVDGWYGYHHSNEQGSGYAADK

ESTQKAIDGVTNKVNSIIDKMNTQFEAVGREFNNLERRIENLNKKMEDGFLDVWTYNAELLVLM

ENERTLDFHDSNVKNLYDKVRLQLRDNAKELGNGCFEFYHKCDNECMESVRNGTYDYPQYSEEA

RLKREEISGVKLESIGIYQILSIYSTVASSLALAIMVAGLSLWMCSNGSLQCRICI

Viet1203_04_D_H2RBS_N158deglyc
(SEQ ID NO: 62)
MEKIVLLFAIVSLVKSDQICIGYHANNSTEQVD Egypt_2876-N3_06_c2.2: Lack of glycosylation at 158 is indicated by larger font (SEQ ID NO: 65)

MEKIVLLLAIVSLVKSDQICIGYHANNSTEQVDTIMEKNVTVTHAQDILEKTHNGKLCDLCGVK

PLILRDCSVAGWLLGNPMCDEFLNVPEWSYIVEKINPANDLCYPGNFNDYEELKHLLSRINHFE

KIQIIPKSSWSDHEASSGVSSACPYQGRSSFFRNVVWLIKKDNAYPTIKRSYNNTNQEDLLVL

WGIHHPNDAAEQTRLYQNPTTYISVGTSTLNQRLVPKIATRSKVNGQSGRMEFFWTILKSNDAI

NFESNGNFIAPENAYKIVKKGDSTIMKSELEYGNCNTKCQTPIGAINSSMPFHNIHPLTIGECP

KYVKSNRLVLATGLRNSPQGERRRKKRGLFGAIAGFIEGGWQGMVDGWYGYHHSNEQGSGYAAD

KESTQKAIDGVTNKVNSIIDKMNTQFEAVGREFNNLERRIENLNKKMEDGFLDVWTYNAELLVL

MENERTLDFHDSNVKNLYDKVRLQLRDNAKELGNGCFEFYHRCDNECMESVRNGTYDYPQYSEE

ARLKREEISGVKLESIGTYQILSIYSTVASSLALAIMVAGLFLWMCSNGSLQCRICI

Egypt_2876-N3_06_c2.2 HA with LS mutation: Lack of glycosylation at 158 is indicated by larger font (SEQ ID NO: 66)

MEKIVLLAIVSLVKSDQICIGYHANNSTEQVDTIMEKNVTVTHAQDILEKTHNGSKLCDLDGVK

PLILRDCSVAGWLLGNPMCDEFLNVPEWSYIVEKINPANDLCYPGNFNDYEELKHLLSRINHFE

KIQIIPKSSWSDHEASSGVSSACPYQGRSSFFRNVVWLIKKDNAYPTIKRSYNNTNQEDLLVL

WGIHHPNDAAEQTRLYQNPTTYISVGTSTLNQRLVPKIATRSKVNGLSSRMEFFWTILKSNDAI

NFESNGNFIAPENAYKIVKKGDSTIMKSELEYGNCNTKCQTPIGAINSSMPFHNIHPLTIGECP

KYVKSNRLVLATGLRNSPQGERRRKKRGLFGAIAGFIEGGWQGMVDGWYGYHHSNEQGSGYAAD

KESTQKAIDGVTNKVNSIIDKMNTQFEAVGREFNNLERRIENLNKKMEDGFLDVWTYNAELLVL

MENERTLDFHDSNVKNLYDKVRLQLRDNAKELGNGCFEFYHRCDNECMESVRNGTYDYPQYSEE

ARLKREEISGVKLESIGTYQILSIYSTVASSLALAIMVAGLFLWMCSNGSLQCRICI

Egypt_2876-N3_06_c2.2 HA with a single Q226L mutation: Lack of glycosylation at 158 is indicated by larger font (SEQ ID NO: 67)

MEKIVLLLAIVSLVKSDQICIGYHANNSTEQVDTIMEKNVTVTHAQDILEKTHNGKLCDLDGVK

PLILRDCSVAGWLLGNPMCDEFLNVPEWSYIVEKINPANDLCYPGNFNDYEELKHLLSRINHFE

KIQIIPKSSWSDHEASSGVSSACPYQGRSSFFRNVVWLIKKDNAYPTIKRSYNNTNQEDLLVL

WTIHHPNDAAEQTRLYQNPTTYISVGTSTLNQRLVPKIATRSKVNGLSGRMEFFWTILKSNDAI

NFESNGNFIAPENAYKIVKKGDSTIMKSELEYGNCNTKCQTPIGAINSSMPFHNIHPLTIGECP

KYVKSNRLVLATGLRNSPQGERRRKKRGLFGAIAGFIEGGWQGMVDGWYGYHHSNEQGSGYAAD

KESTQKAIDGVTNKVNSIIDKMNTQFEAVGREFNNLERRIENLNKKMEDGFLDVWTYNAELLVL

MENERTLDFHDSNVKNLYDKVRLQLRDNAKELGNGCFEFYHRCDNECMESVRNGTYDYPQYSEE

ARLKREEISGVKLESIGTYQILSIYSTVASSLALAIMVAGLFLWMCSNGSLQCRICI

Viet1203_04_D with T160A/Q226L double mutation:

(SEQ ID NO: 68)

MEKIVLLFAIVSLVKSDQICIGYHANNSTEQVDTIMEKNVTVTHAQDILEKKHNGKLCDLCGVK

PLILRDSVAGWLLGNPMCDEFINVPEWSYIVEKANPVNDLCYPGDFNDYEELKHLLSRINHFE

KIQIIPKSSWSDHEASSGVSSACPYQGKPSFFRNVVWLIKKNNAYPTIKRSYNNTNQEDLLVLW

GIHHPNDAAEQTRLYQNPTTYISVGTSTLNQRLVPRIATRSKVNGLSGRMEFFWTILKPNDAIN

FESNGNFIAPEYAYKIVKKGDSTIMKSELEYGNCNTKCQTPMGAINSSMPFHNIHPLTIGECPK

YVKSNRLVLATGLRNSPQRERRRKKRGLFGAIAGFIEGGWQGMVDGWYGYHHSNEQGSGYAADK

ESTQKAIDGVTNKVNSIIDKMNTQFEAVGREFNNLERRIENLNKKMEDGFLDVWTYNAELLVLM

ENERTLDFHDSNKNLYDKVRLQLRDNAKELGNGCFEFYHKCDNECMESVRNGTYDYPQYSEEA

RLKREEISGVKLESIGIYQILSIYSTVASSLALAIMVAGLSLWMCSNGSLQCRICI cdViet_08: WT HA that already possesses the Lys192 and Met193 charge combination as observed in H2N2 (indicated by larger font)
(SEQ ID NO: 69)

MEKIVLLLAIIGLVKSDQICVGYHANNSTEQVDTIMEKNITVTHAQDILEKTHNGKLCNLNGVK

PLILKDCSVAGWLLGNPMCDEFLNVSEWSYIVEKASPANGLCYPGDFNDYEELKHLLSRINHFE

KIKIIPKSYWSNHETSLGVSSACSYLENPSFFRNVVWLTKKNNTYPPIKVNYTNANQKDLLVLW

NFDSNGNFIAPEYAYKIVKKGDSAIMKSELEYGNCNTKCQTPIGAINSSMPFHNIHPLTIGECP

KYVKSNRLVLATCLRNAPQIEGRRRKRGLFGAIAGFIEGGWQGMVDGWYGYHHSNEQGSGYAAD

KESTQKAIDGITNKINSIIDKMNTQFEAVGREFNNLERRIENLNKKMEDGFLDVWTYNAELLVL

MENERTLDFHDSNVKNLYEKVRLQLRDNAKELGNGCFEFYHKCDNECMESVKNGTYDYPQYSEE

ARLNREEISGVKLESIVTYQILSIYSTVASSLALAIMVAGLSLWMCSNGSLQCRICI cdViet_08_H2RBS: Deletion + 6 mutations (SEQ ID NO: 70)

MEKIVLLLAIIGLVKSDQICVGYHANNSTEQVDTIMEKNITVTHAQDILEKTHNGKLCNLNGVK

PLILKDCSVAGWLLGNPMCDEFLNVSEWSYIVEKASPANGLCYPGDFNDYEELKHLLSRINHFE

KIKIIPKSYWSNH TS*T*GVS*R*ACSYLENPSFFRNVVWLTKKNNTYPPIKVNYTNANQKDLLVLW

GIHHPN*D*EAEQKMIYQNLNTYVSVGTSTLNQRLVPKIATRSKVNG*LGS*RMDFFWTILKPNDTI

NFDSNGNFIAPEYAYKIVKKGDSAIMKSELEYGNCNTKCQTPIGAINSSMPFHNIHPLTIGECP

KYVKSNRLVLATGLRNAPQIEGRRRKRGLFGAIAGFIEGGWQGMVDGWYGYHHSNEQGSGYAAD

KESTQKAIDGITNKINSIIDKMNTQFEAVGREFNNLERRIENLNKKMEDGFLDVWTYNAELLVL

MENERTLDFHDSNVKNLYEKVRLQLRDNAKELGNGCFEFYHKCDNECMESVKNGTYDYPQYSEE

ARLNREEISGVKLESIVTYQILSIYSTVASSLALAIMVAGLSLWMCSNGSLQCRICI cdViet_08_H2RBS: Deletion + 5 mutations (SEQ ID NO: 71)

MEKIVLLLAIIGLVKSDQICFGYHANNSTEQVDTIMEKNITVTHAQDILEKTHNGKLCNLNGVK

PLILKDCSVAGWLLGNPMCDEFLNVSEWSYIVEKASPANGLCYPGDFNDYEELKHLLSRINHFE

KIKIIPKSYWSNH TS*T*GVS*R*ACSYLENPSFFRNVVWLTKKNNTYPPIKVNYTNANWQKDLLVLW

GIHHPNNEAEQKMIYQNLNTYVSVGTSTLNQRLVPKIATRSKVNG*LGS*RMDFFWTILKPNDTI

NFDSNGNFIAPEYAYKIVKKGDSAIMKSELEYGNCNTKCQTPIGAINSSMPFHNIHPLTIGECP

KYVKSNRLVLATGLRNAPQIEGRRRKRGLFGAIAGFIEGGWQGMVDGWYGYHHSNEQGSGYAAD

KESTQKAIDGITNKINSIIDKMNTQFEAVGREFNNLERRIENLNKKMEDGFLDWTYNAELLVL

MENERTLDFHDSNVKNLYEKVRLQLRDNAKELGNGCFEFYHKCDNECMESVKNGTYDYPQYSEE

ARLNREEISGVKLESIVTYQILSIYSTVASSLALAIMVAGLSLWMCSNGSLQCRICI cdViet_08_H2RBSmin: Deletion + 4 mutations (SEQ ID NO: 72)

MEKIVLLLAIIGLVKSDQICVGYHANNSTEQVDTIMEKNITVTHAQDILEKTHNGKLCNLNGVK

PLILKDCSVAGWLLGNPMCDEFLNVSEWSYIVEKASPANGLCYPGDFNDYEELKHLLSRINHFE

KIKIIPKSYWSNH TS*T*GVS*R*ACSYLENPSFFRNVVWLTKKNNTYPPIKVNYTNANQKDLLVLW

GIHHPNNEAEQKMIYQNLNTYVSVGTSTLNQRLVPKIATRSKVNG*LG*GRMDFFWTILKPNDTI

NFDSNGNFIAPEYAYKIVKKGDSAIMKSELEYGNCNTKCQTPIGAINSSMPFHNIHPLTIGECP

KYVKSNRLVLATGLRNAPQIEGRRRKRGLFGAIAGFIEGGWQGMVDGWYGYHHSNEQGSGYAAD

KESTQKAIDGITNKINSIIDKMNTQFEAVGREFNNLERRIENLNKKMEDGFLDVWTYNAELLVL

MENERTLDFHDSNVKNLYEKVRLQLRDNAKELGNGCFEFYHKCDNECMESVKNGTYDYPQYSEE

ARLNREEISGVKLESIVTYQILSIYSTVASSLALAIMVAGLSLWMCSNGSLQCRICI cdEgy_07: Already possesses the deletion in the 130 loop (SEQ ID NO: 73)

MEKIVLLLAIVSLVKSDQICIGYHANNSTEQVDTIMEKNVTVTHAQDILEKTHNGKLCNLDGVK

PLILRDCSVAGWLLGNPMCDEFLNVPEWSYIVEKINPANDLCYPGNFNDYEELKHLLSRINHFE

KIQIIPKNSWSDHEASGVSSACPYQGRSSFFRNVVWLTKKDNAYPTIKRSYNNTNQEDLLVLWG

IHHPNDAAEQTRLYQNPTTQISVGTSTLNQRLVPKIATRSKVNGQSGRMEFFWTILKSNDAINF

ESNGNFIAPENAYKIVKKGDSTIMKSELEYGNCNTKCQTPIGAINSSMPFHNIHPLTIGECPDY

VKSNRLVLATGLRNSPQGERRRKRRGLFGAIAGFIEGGWQGMVDGWYGYHHSNEQGSGYAADKE

STQKAIDGVTNKVNSIIDKMNTQFEAVGREFNNLERRIENLNKKMEDGFLDVWTYNAELLVLME

NERTLDFHDSNVKNLYDKVRLQLLRDNAKELGNGCFEFYHRCDNECMESVRNGTYDYQYSEEAR

LKREEISGVKLESIGTYQILSIYSTVASSLALAIMVAGLFLWMCSNGSLQCRICI cdEgy_07_LS: LS mutation on cdEgy_07

(SEQ ID NO: 74)

MEKIVLLLAIVSLVKSDQICIGYHANNSTEQVDTIMEKNVTVTHAQDILEKTHNGKLCNLDGVK

PLILRDCSVAGWLLGNPMCDEFLNVPEWSYIVEKINPANDLCYPGNFNDYEELKHLLSRINHFE

KIQIIPKNSWSDHEASGVSSACPYQGRSSFFRNVVWLTKKDNAYPTIKRSYNNTNOEDLLVLWG

IHHPNDAAEQTRLYQNPTTQISVGTSTLNQRLVPKIATRSKVNGLSSRMEFFWTILKSNDAINF

ESNGNFIAPENAYKIVKKGDSTIMKSELEYGNCNTKCQTPIGAINSSMPFHNIHPLTIGECPDY

VKSNRLVLATGLRNSPQGERRRKRRGLFGAIAGFIEGGWQGMVDGWYGYHHSNEQGSGYAADKE

STQKAIDGVTNKVNSIIDKMNTQFEAVGREFNNLERRIENLNKKMEDGFLDVWTYNAELLVLME

NERTLDFHDSNVKNLYDKVRLQLRDNAKELGNGCFEFYHRCDNECMESVRNGTYDYPQYSEEAR

LKREEISGVKLESIGTYQILSIYSTVASSLALAIMVAGLFLWMCSNGSLQCRICI cdEgy_07_H2RBS: 8 mutations (SEQ ID NO: 75)

MEKIVLLLAIVSLVKSDQICIGYHANNSTEQVDTIMEKNVTVTHAQDILEKTHNGKLCNLDGVK

PLILRDCSVAGWLLGNPMCDEFLNVPEWSYIVEKINPANDLCYPGNFNDYEELKHLLSRINHFE

KIQIIPKNSWSDHTASGVSRACPYQRSSFFRNVVWLTKKDNAYPTIKRSYNNTNQEDLLVLWG

IHHPNDEAEQRALYQNPTTQISVGTSTLNQRLVPKIATRSKVNGLGSRMEFFWTILKSNDAINF

ESNGNFIAPENAYKIVKKGDSTIMKSELEYGNCNTKCQTPIGAINSSMPFHNIHPLTIGECPKY

VKSNRLVLATGLRNSPQGERRRKRRGLFGAIAGFIEGGWQGMVDGWYGYHHSNEQGSGYAADKE

STQKAIDGVTNKVNSIIDKMNTQFEAVGREFNNLERRIENLNKKMEDGFLDVWTYNAELLVLME

NERTLDFHDSNVKNLYDKVRLQLRDNAKELGNGCFEFYHRCDNECMESVRNGTYDYPQYSEEAR

LKREEISGVKLESIGTYQILSIYSTVASSLALAIMVAGLFLWMCSNGSLQCRICI

Discussion

Several experimental studies have attempted to identify determinants of human receptor specificity of H5 HA. However, these studies focused on replacement of amino acids at the RBS sites directly without considering the influence of the neighboring positions. Further, no prior study has even considered insertions or deletions as possible determinants of host specificity. Structure-based investigations have also fallen short of identifying the key determinants of H5 HA mainly because the structural effects of a deletion cannot be accurately evaluated using in silico analysis. In contrast, the present inventors, for the first time, have recognized the importance of and have employed a sequence alignment approach to engineering proteins with novel properties. The present invention encompasses the recognition that a similar approach can be used for identifying determinants of host specificity of other HA subtypes that have shown potential to infect humans in recent years (H7, H9, etc.).

Materials and Methods

Dose Response Direct Binding of Wild Type HA Polypeptides to Glycans of Different Topology Direct binding assays typically utilize glycan arrays in which defined glycan structures (e.g., monovalent or multivalent) are presented on a support (e.g., glass slides or well plates), often using a polymer backbone. In so-called "sequential" assays, trimeric HA polypeptide is bound to the array and then is detected, for example using labeled (e.g., with FITC or horse radish peroxidase) primary and secondary antibodies. In "multivalent" assays, trimeric HA is first complexed with primary and secondary antibodies (typically in a 4:2:1 HA:primary:secondary ratio), such that there are 12 glycan binding sites per pre-complexed HA, and is then contacted with the array. Binding assays are typically carried out over a range of HA concentrations, so that information is obtained regarding relative affinities for different glycans in the array.

For example, direct binding studies were performed with arrays having different glycans such as 3'SLN, 6'SLN, 3'SLN-LN, 6'SLN-LN, and 3'SLN-LN-LN, where LN represents Galβ1-4GlcNAc, 3' represents Neu5Acα2-3, and 6' represents Neu5Acα2-6). Specifically, biotinylated glycans (50 µl of 120 pmol/ml) were incubated overnight (in PBS at 4° C.) with a streptavidin-coated High Binding Capacity 384-well plate that was previously rinsed three times with PBS. The plate was then washed three times with PBS to remove excess glycan, and was used without further processing.

Appropriate amounts of His-tagged HA protein, primary antibody (mouse anti 6×His tag (SEQ ID NO: 207)) and secondary antibody (HRP conjugated goat anti-mouse IgG) were incubated in a ratio of 4:2:1 HA:primary:secondary for 15 minutes on ice. The mixture (i.e., precomplexed HA) was then made up to a final volume of 250 µl with 1% BSA in PBS. 50 µl of the precomplexed HA was then added to the glycan-coated wells in the 384-well plate, and was incubated at room temperature for 2 hours. The wells were subsequently washed three times with PBS containing 0.05% TWEEN-20, and then three times with PBS. HRP activity was estimated using Amplex Red Peroxidase Kit (Invitrogen, CA) according to the manufacturer's instructions. Serial dilutions of HA precomplexes were studied. Appropriate negative (non-sialylated glycans) and background (no glycans or no HA) controls were included, and all assays were done in triplicate.

Example 2: Exemplary Human Binding H5 HA Polypeptide Variants

In some embodiments, HA polypeptides are H5 polypeptides. In some such embodiments, H5 polypeptides in accordance with the invention show binding (e.g., high affinity and/or specificity binding) to umbrella glycans. In some such embodiments, H5 polypeptides in accordance with the invention show either comparable (to umbrella topology binding) high affinity-binding to cone topology glycans or reduced binding (e.g., lower affinity and/or specificity relative to umbrella-topology glycans) to cone topology glycans.

In some embodiments, H5 HA polypeptides in accordance with the invention bind to receptors found on human upper respiratory epithelial cells. Furthermore, H5 HA polypeptides in accordance with the invention bind to a plurality of different α2-6 sialylated glycans. In some embodiments, H5 HA polypeptides bind to umbrella glycans.

In some embodiments, H5 HA polypeptides in accordance with the invention bind to HA receptors in the bronchus and/or trachea. In some embodiments, H5 HA polypeptides are not able to bind receptors in the deep lung, and in some embodiments, H5 HA polypeptides are able to bind receptors in the deep lung. In some embodiments, H5 HA polypeptides are not able to bind to α2-3 sialylated glycans, and in some embodiments H5 HA polypeptides are able to bind to α2-3 sialylated glycans.

In some embodiments, H5 HA polypeptides in accordance with the invention are variants of a parent H5 HA (e.g., an H5 HA found in a natural influenza isolate). For example, in some embodiments, H5 HA polypeptides in accordance with the invention have at least one amino acid substitution, as compared with wild type H5 HA, within or affecting the glycan binding site. In some embodiments, such substitutions are of amino acids that interact directly with bound glycan; in some embodiments, such substitutions are of amino acids that are one degree of separation removed from those that interact with bound glycan, in that the one degree of separation removed-amino acids either (1) interact with the direct-binding amino acids; (2) otherwise affect the ability of the direct-binding amino acids to interact with glycan, but do not interact directly with glycan themselves; or (3) otherwise affect the ability of the direct-binding amino acids to interact with glycan, and also interact directly with glycan themselves. H5 HA polypeptides in accordance with the invention contain substitutions of one or more direct-binding amino acids, one or more first degree of separation—amino acids, one or more second degree of separation-amino acids, or any combination of these. In some embodiments, H5 HA polypeptides in accordance with the invention may contain substitutions of one or more amino acids with even higher degrees of separation.

In some embodiments, H5 HA polypeptide variants in accordance with the invention have at least two, three, four, five or more amino acid substitutions as compared with wild type H5 HA; in some embodiments H5 HA polypeptide variants in accordance with the invention have two, three, or four amino acid substitutions. In some embodiments, all such amino acid substitutions are located within the glycan binding site.

In some embodiments, HA polypeptide variants in accordance with the invention contain one or more amino acid substitutions as described in any of U.S. Patent Publication Number 2009/0269342 and 2010/0004195, and in U.S. patent application Ser. No. 12/829,931, filed Jul. 2, 2010, entitled "COMPOSITIONS AND METHODS FOR DIAGNOSING AND/OR TREATING INFLUENZA INFECTION" (all of which are incorporated herein by reference).

In some embodiments, H5 HA polypeptide variants have sequence substitutions at positions corresponding to one or more of residues 95, 98, 128, 130, 131, 132, 133, 135, 136, 137, 138, 145, 153, 155, 156, 158, 159, 160, 183, 186, 187, 188, 189, 190, 192, 193, 194, 195, 196, 219, 221, 222, 224, 225, 226, 227, and 228. In some embodiments, H5 HA polypeptide variants have one or more amino acid substitutions relative to a wild type parent H5 HA at residues selected from the group consisting of residues 95, 98, 128, 130, 131, 132, 133, 135, 136, 137, 138, 145, 153, 155, 156, 158, 159, 160, 183, 186, 187, 188, 189, 190, 192, 193, 194, 195, 196, 219, 221, 222, 224, 225, 226, 227, and 228. In some embodiments, H5 HA polypeptide variants have one or more amino acid substitutions relative to a wild type parent H5 HA at any 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, or 37 residues selected from the group consisting of residues 95, 98, 128, 130, 131, 132, 133, 135, 136, 137, 138, 145, 153, 155, 156, 158, 159, 160, 183, 186, 187, 188, 189, 190, 192, 193, 194, 195, 196, 219, 221, 222, 224, 225, 226, 227, and 228.

In some embodiments, H5 HA polypeptide variants have sequence substitutions that reduce or abolish glycosylation a site corresponding to position 158. In some embodiments, H5 HA polypeptide variants have sequence substitutions that affect and/or alter the identity and/or structure of the glycan linked to a site corresponding to position 158. In some embodiments, such a sequence substitution is a mutation at a site corresponding to position 158, e.g., Asn158Xaa, wherein Xaa is any amino acid other than Asn. In some embodiments, such a sequence substitution is a mutation at a site corresponding to position 160, e.g., Thr160Xaa, wherein Xaa is any amino acid other than Asn. In some embodiments, such a sequence substitution comprises the mutation Thr160Ala. In some embodiments, a sequence substitution that reduces, abolishes, affects, or alters glycosylation at a site corresponding to position 158 can make an H5 HA polypeptide more closely resemble (e.g., both structurally and functionally) an H2 HA polypeptide. In some embodiments, a mutation at a site corresponding to position 160 (e.g., Thr160Xaa, such as Thr160Ala) can make an H5 HA polypeptide more closely resemble (e.g., both structurally and functionally) an H2 HA polypeptide.

In some embodiments, an H5 HA polypeptide variant has one or more sequence substitutions relative to a wild type parent H5 HA at positions corresponding to one or more of residues 226, 228, and 160. In some embodiments, an H5 HA polypeptide variant has one or more sequence substitutions relative to a wild type parent H5 HA at positions corresponding to residues 226, 228, and 160. In some embodiments, an H5 HA polypeptide variant has one or more sequence substitutions relative to a wild type parent H5 HA at positions corresponding to residues 226 and 160. In some embodiments, an H5 HA polypeptide variant has one or more sequence substitutions relative to a wild type parent H5 HA at positions corresponding to residues 228 and 160. In some embodiments, an H5 HA polypeptide variant has one or more sequence substitutions relative to a wild type parent H5 HA at positions corresponding to residues 226 and 228.

In some embodiments, an H5 HA polypeptide variant has one or more sequence substitutions relative to a wild type parent H5 HA at positions corresponding to one or more of residues 226, 228, and 158. In some embodiments, an H5 HA polypeptide variant has one or more sequence substitutions relative to a wild type parent H5 HA at positions corresponding to residues 226, 228, and 158. In some embodiments, an H5 HA polypeptide variant has one or more sequence substitutions relative to a wild type parent H5 HA at positions corresponding to residues 226 and 158. In some embodiments, an H5 HA polypeptide variant has one or more sequence substitutions relative to a wild type parent H5 HA at positions corresponding to residues 228 and 158. In some embodiments, an H5 HA polypeptide variant has one or more sequence substitutions relative to a wild type parent H5 HA at positions corresponding to residues 226 and 228.

In some embodiments, an H5 HA polypeptide variant has one or more sequence substitutions that include a deletion in one or more of the loop regions of an HA polypeptide. In some embodiments, an H5 HA polypeptide variant has one or more sequence substitutions that include a deletion at a site corresponding to the 128-137 loop region of an HA polypeptide. In some embodiments, an H5 HA polypeptide variant has one or more sequence substitutions that include a deletion at one or more of amino acid positions corresponding to residues 128, 129, 130, 131, 132, 133, 134, 135, 136, and/or 137 of an HA polypeptide. In some embodiments, an H5 HA polypeptide variant has one or more sequence substitutions that include a deletion at a site corresponding to the 128-134 loop region of an HA polypeptide. In some embodiments, an H5 HA polypeptide variant has one or more sequence substitutions that include a deletion at one or more of amino acid positions corresponding to residues 128, 129, 130, 131, 132, 133, and/or 134 of an HA polypeptide. In some embodiments, an H5 HA polypeptide variant has one or more sequence substitutions that include a deletion of an amino acid corresponding to residue 130. In some embodiments, such loop region substitutions can make an H5 HA polypeptide more closely resemble (e.g., both structurally and functionally) an H2 HA polypeptide. In some embodiments, a deletion of an amino acid corresponding to residue 130 can make an H5 HA polypeptide more closely resemble (e.g., both structurally and functionally) an H2 HA polypeptide.

In some embodiments, an H5 HA polypeptide variant has one or more sequence substitutions relative to a wild type parent HA at positions corresponding to one or more of residues 131, 132, 133, 135, 137, 155, 188, 192, 193, 221, 226, 227, 228, and 130. In some embodiments, an H5 HA polypeptide variant has one or more sequence substitutions relative to a wild type parent HA at positions corresponding to any 1, 2, 3, 4, 5, 6, 7, 8, 9, 10, 11, 12, 13, or 14 of residues 131, 132, 133, 135, 137, 155, 188, 192, 193, 221, 226, 227, 228, and 130. In some embodiments, an H5 HA polypeptide variant has one or more sequence substitutions relative to a wild type parent HA at positions corresponding to (1) 130, and (2) one or more of residues 131, 132, 133, 135, 137, 155, 188, 192, 193, 221, 226, 227, and 228. In some embodiments, an H5 HA polypeptide variant has one or more sequence substitutions relative to a wild type parent HA at positions corresponding to (1) 130, and (2) any 1, 2, 3, 4, 5, 6, 7, 8, 9, 10, 11, 12, or 13 of residues 131, 132, 133, 135, 137, 155, 188, 192, 193, 221, 226, 227, and 228.

In some embodiments, an H5 HA polypeptide variant has one or more sequence substitutions relative to a wild type parent HA at positions corresponding to one or more of residues 131, 132, 135, 188, 192, 221, and 130. In some embodiments, an H5 HA polypeptide variant has one or more sequence substitutions relative to a wild type parent HA at positions corresponding to any 1, 2, 3, 4, 5, 6, or 7 of residues 131, 132, 135, 188, 192, 221, and 130. In some embodiments, an H5 HA polypeptide variant has one or more sequence substitutions relative to a wild type parent HA at positions corresponding to (1) 130, and (2) one or more of residues 131, 132, 135, 188, 192, and 221. In some embodiments, an H5 HA polypeptide variant has one or more sequence substitutions relative to a wild type parent HA at positions corresponding to (1) 130, and (2) any 1, 2, 3, 4, 5, or 6 of residues 131, 132, 135, 188, 192, and 221.

In some embodiments, an H5 HA polypeptide variant has one or more sequence substitutions relative to a wild type parent HA at positions corresponding to one or more of residues 133, 137, 155, 193, 226, 227, 228, and 130. In some embodiments, an H5 HA polypeptide variant has one or more sequence substitutions relative to a wild type parent HA at positions corresponding to any 1, 2, 3, 4, 5, 6, 7, or of residues 133, 137, 155, 193, 226, 227, 228, and 130. In some embodiments, an H5 HA polypeptide variant has one or more sequence substitutions relative to a wild type parent HA at positions corresponding to (1) 130, and (2) one or more of residues 133, 137, 155, 193, 226, 227, and 228. In some embodiments, an H5 HA polypeptide variant has one or more sequence substitutions relative to a wild type parent HA at positions corresponding to (1) 130, and (2) any 1, 2, 3, 4, 5, 6, or 7 of residues 133, 137, 155, 193, 226, 227, and 228.

In some embodiments, an H5 HA polypeptide variant has one or more sequence substitutions relative to a wild type parent HA at positions corresponding to one or more of residues 130, 192, and 193. In some embodiments, an H5 HA polypeptide variant has one or more sequence substitutions relative to a wild type parent HA at positions corresponding to any 1, 2, or 3 of residues 130, 192, 193. In some embodiments, an H5 HA polypeptide variant has one or more sequence substitutions relative to a wild type parent HA at positions corresponding to (1) 130, and (2) one or both of residues 192 and 193.

In some embodiments, an H5 HA polypeptide variant has one or more sequence substitutions relative to a wild type parent HA at positions corresponding to one or more of residues 131, 132, 133, 135, 137, 155, 158, 160, 188, 192, 193, 221, 226, 227, 228, and 130. In some embodiments, an H5 HA polypeptide variant has one or more sequence substitutions relative to a wild type parent HA at positions corresponding to any 1, 2, 3, 4, 5, 6, 7, 8, 9, 10, 11, 12, 13, 14, 15, or 16 of residues 131, 132, 133, 135, 137, 155, 158, 160, 188, 192, 193, 221, 226, 227, 228, and 130. In some embodiments, an H5 HA polypeptide variant has one or more sequence substitutions relative to a wild type parent HA at positions corresponding to (1) 130, and (2) one or more of residues 131, 132, 133, 135, 137, 155, 158, 160, 188, 192, 193, 221, 226, 227, and 228. In some embodiments, an H5 HA polypeptide variant has one or more sequence substitutions relative to a wild type parent HA at positions corresponding to (1) 130, and (2) any 1, 2, 3, 4, 5, 6, 7, 8, 9, 10, 11, 12, 13, 14, or 15 of residues 131, 132, 133, 135, 137, 155, 158, 160, 188, 192, 193, 221, 226, 227, and 228.

In some embodiments, an H5 HA polypeptide variant has one or more sequence substitutions relative to a wild type parent HA at positions corresponding to one or more of residues 137, 188, 192, 193, 226, 228, and 130. In some embodiments, an H5 HA polypeptide variant has one or more sequence substitutions relative to a wild type parent HA at positions corresponding to any 1, 2, 3, 4, 5, 6, or 7 of residues 137, 188, 192, 193, 226, 228, and 130. In some embodiments, an H5 HA polypeptide variant has one or more sequence substitutions relative to a wild type parent HA at positions corresponding to (1) 130, and (2) one or more of residues 137, 188, 192, 193, 226, and 228. In some embodiments, an H5 HA polypeptide variant has one or more sequence substitutions relative to a wild type parent HA at positions corresponding to (1) 130, and (2) any 1, 2, 3, 4, 5, or 6 of residues 137, 188, 192, 193, 226, and 228.

In some embodiments, an H5 HA polypeptide variant has one or more sequence substitutions relative to a wild type parent HA at positions corresponding to one or more of residues 137, 188, 192, 193, 226, 227, 228, 131, 132, 133, and 130. In some embodiments, an H5 HA polypeptide variant has one or more sequence substitutions relative to a wild type parent HA at positions corresponding to any 1, 2, 3, 4, 5, 6, 7, 8, 9, 10, or 11 of residues 137, 188, 192, 193, 226, 227, 228, 131, 132, 133, and 130. In some embodiments, an H5 HA polypeptide variant has one or more sequence substitutions relative to a wild type parent HA at positions corresponding to (1) 130, and (2) one or more of residues 137, 188, 192, 193, 226, 227, 228, 131, 132, and 133. In some embodiments, an H5 HA polypeptide variant has one or more sequence substitutions relative to a wild type parent HA at positions corresponding to (1) 130, and (2) any 1, 2, 3, 4, 5, 6, 7, 8, 9, or 10 of residues 137, 188, 192, 193, 226, 227, 228, 131, 132, and 133.

In some embodiments, an H5 HA polypeptide variant has one or more sequence substitutions relative to a wild type parent HA at positions corresponding to one or more of residues 227, 131, 132, 133, and 130. In some embodiments, an H5 HA polypeptide variant has one or more sequence substitutions relative to a wild type parent HA at positions corresponding to any 1, 2, 3, 4, or 5 of residues 227, 131, 132, 133, and 130. In some embodiments, an H5 HA polypeptide variant has one or more sequence substitutions relative to a wild type parent HA at positions corresponding to (1) 130, and (2) one or more of residues 227, 131, 132, and 133. In some embodiments, an H5 HA polypeptide variant has one or more sequence substitutions relative to a wild type parent HA at positions corresponding to (1) 130, and (2) any 1, 2, 3, or 4 of residues 227, 131, 132, and 133.

In some embodiments, an H5 HA polypeptide variant has one or more sequence substitutions relative to a wild type parent HA at positions corresponding to one or more of residues 131, 133, 137, 155, 188, 192, 193, 226, 227, 228, and 130. In some embodiments, an H5 HA polypeptide variant has one or more sequence substitutions relative to a wild type parent HA at positions corresponding to any 1, 2, 3, 4, 5, 6, 7, 8, 9, 10, or 11 of residues 131, 133, 137, 155, 188, 192, 193, 226, 227, 228, and 130. In some embodiments, an H5 HA polypeptide variant has one or more sequence substitutions relative to a wild type parent HA at positions corresponding to (1) 130, and (2) one or more of residues 131, 133, 137, 155, 188, 192, 193, 226, 227, and 228. In some embodiments, an H5 HA polypeptide variant has one or more sequence substitutions relative to a wild type parent HA at positions corresponding to (1) 130, and (2) any 1, 2, 3, 4, 5, 6, 7, 8, 9, or 10 of residues 131, 133, 137, 155, 188, 192, 193, 226, 227, and 228.

In some embodiments, an H5 HA polypeptide variant has one or more sequence substitutions relative to a wild type parent HA at positions corresponding to one or more of residues 131, 133, 137, 155, 188, 192, 193, 226, 228, and 130. In some embodiments, an H5 HA polypeptide variant has one or more sequence substitutions relative to a wild type parent HA at positions corresponding to any 1, 2, 3, 4, 5, 6, 7, 8, 9, or 10 of residues 131, 133, 137, 155, 188, 192, 193, 226, 228, and 130. In some embodiments, an H5 HA polypeptide variant has one or more sequence substitutions relative to a wild type parent HA at positions corresponding to (1) 130, and (2) one or more of residues 131, 133, 137, 155, 188, 192, 193, 226, and 228. In some embodiments, an H5 HA polypeptide variant has one or more sequence substitutions relative to a wild type parent HA at positions corresponding to (1) 130, and (2) any 1, 2, 3, 4, 5, 6, 7, 8, or 9 of residues 131, 133, 137, 155, 188, 192, 193, 226, and 228.

In some embodiments, an H5 HA polypeptide variant has one or more sequence substitutions relative to a wild type parent HA at positions corresponding to one or more of residues 131, 133, 137, 155, 159, 160, 188, 192, 193, 226, 227, 228, and 130. In some embodiments, an H5 HA polypeptide variant has one or more sequence substitutions relative to a wild type parent HA at positions corresponding to any 1, 2, 3, 4, 5, 6, 7, 8, 9, 10, 11, 12, or 13 of residues 131, 133, 137, 155, 159, 160, 188, 192, 193, 226, 227, 228, and 130. In some embodiments, an H5 HA polypeptide variant has one or more sequence substitutions relative to a wild type parent HA at positions corresponding to (1) 130, and (2) one or more of residues 131, 133, 137, 155, 159, 160, 188, 192, 193, 226, 227, and 228. In some embodiments, an H5 HA polypeptide variant has one or more sequence substitutions relative to a wild type parent HA at positions corresponding to (1) 130, and (2) any 1, 2, 3, 4, 5, 6, 7, 8, 9, 10, 11, or 12 of residues 131, 133, 137, 155, 159, 160, 188, 192, 193, 226, 227, and 228.

In some embodiments, an H5 HA polypeptide variant has one or more sequence substitutions relative to a wild type parent HA at positions corresponding to one or more of residues 131, 133, 137, 155, 159, 160, 188, 192, 193, 226, 228, and 130. In some embodiments, an H5 HA polypeptide variant has one or more sequence substitutions relative to a wild type parent HA at positions corresponding to any 1, 2, 3, 4, 5, 6, 7, 8, 9, 10, 11, or 12 of residues 131, 133, 137, 155, 159, 160, 188, 192, 193, 226, 228, and 130. In some embodiments, an H5 HA polypeptide variant has one or more sequence substitutions relative to a wild type parent HA at positions corresponding to (1) 130, and (2) one or more of residues 131, 133, 137, 155, 159, 160, 188, 192, 193, 226, and 228. In some embodiments, an H5 HA polypeptide variant has one or more sequence substitutions relative to a wild type parent HA at positions corresponding to (1) 130, and (2) any 1, 2, 3, 4, 5, 6, 7, 8, 9, 10, or 11 of residues 131, 133, 137, 155, 159, 160, 188, 192, 193, 226, and 228.

In some embodiments, an H5 HA polypeptide variant has one or more sequence substitutions relative to a wild type parent HA at positions corresponding to one or more of residues 137, 188, 192, 193, 226, 228, 131, 132, 133, 221, 227, and 130. In some embodiments, an H5 HA polypeptide variant has one or more sequence substitutions relative to a wild type parent HA at positions corresponding to any 1, 2, 3, 4, 5, 6, 7, 8, 9, 10, 11, or 12 of residues 137, 188, 192, 193, 226, 228, 131, 132, 133, 221, 227, and 130. In some embodiments, an H5 HA polypeptide variant has one or more sequence substitutions relative to a wild type parent HA at positions corresponding to (1) 130, and (2) one or more of residues 137, 188, 192, 193, 226, 228, 131, 132, 133, 221, and 227. In some embodiments, an H5 HA polypeptide variant has one or more sequence substitutions relative to a wild type parent HA at positions corresponding to (1) 130, and (2) any 1, 2, 3, 4, 5, 6, 7, 8, 9, 10, or 11 of residues 137, 188, 192, 193, 226, 228, 131, 132, 133, 221, and 227.

In some embodiments, an H5 HA polypeptide variant has one or more sequence substitutions relative to a wild type parent HA at positions corresponding to one or more of residues 131, 132, 133, 221, 227, and 130. In some embodiments, an H5 HA polypeptide variant has one or more sequence substitutions relative to a wild type parent HA at positions corresponding to any 1, 2, 3, 4, 5, or 6 of residues 131, 132, 133, 221, 227, and 130. In some embodiments, an H5 HA polypeptide variant has one or more sequence substitutions relative to a wild type parent HA at positions corresponding to (1) 130, and (2) one or more of residues 131, 132, 133, 221, and 227. In some embodiments, HA polypeptide variants (e.g., H5 HA polypeptide variants) have sequence substitutions relative to a wild type parent HA at positions corresponding to (1) 130, and (2) any 1, 2, 3, 4, or 5 of residues 131, 132, 133, 221, and 227.

In some embodiments, a H5 HA polypeptide variant has one or more amino acid substitutions relative to a wild type parent H5 HA at residues selected from amino acids located in the region of the receptor that directly binds to the glycan, including but not limited to residues 98, 136, 153, 155, 183, and 194. In some embodiments, an H5 HA polypeptide variant has one or more amino acid substitutions relative to a wild type parent H5 HA at residues selected from amino acids located adjacent to the region of the receptor that directly binds the glycan, including but not limited to (a) residues 98 and 195, (b) residues 98, 138, 186, 187, 195, and 228), or (c) residues 138, 186, 187, and 228.

In some embodiments, an HA polypeptide variant, and particularly an H5 polypeptide variant has one or more amino acid substitutions relative to a wild type parent HA at residues selected from amino acids that are one degree of separation removed from those that interact with bound glycan, in that the one degree of separation removed-amino acids either (1) interact with the direct-binding amino acids; (2) otherwise affect the ability of the direct-binding amino acids to interact with glycan, but do not interact directly with glycan themselves; or (3) otherwise affect the ability of the direct-binding amino acids to interact with glycan, and also interact directly with glycan themselves, including but not limited to residues 98, 138, 186, 187, 195, and 228.

In some embodiments, an HA polypeptide variant, and particularly an H5 polypeptide variant, has one or more amino acid substitutions relative to a wild type parent HA at residues selected from amino acids that are one degree of separation removed from those that interact with bound glycan, in that the one degree of separation removed-amino acids either (1) interact with the direct-binding amino acids; (2) otherwise affect the ability of the direct-binding amino acids to interact with glycan, but do not interact directly with glycan themselves; or (3) otherwise affect the ability of the direct-binding amino acids to interact with glycan, and also interact directly with glycan themselves, including but not limited to residues 138, 186, 187, and 228.

In some embodiments, an HA polypeptide variant, and particularly an H5 polypeptide variant, has one or more amino acid substitutions relative to a wild type parent HA at residues selected from amino acids that are one degree of separation removed from those that interact with bound glycan, in that the one degree of separation removed-amino acids either (1) interact with the direct-binding amino acids; (2) otherwise affect the ability of the direct-binding amino acids to interact with glycan, but do not interact directly with glycan themselves; or (3) otherwise affect the ability of the direct-binding amino acids to interact with glycan, and also interact directly with glycan themselves, including but not limited to residues 98 and 195.

In some embodiments, an HA polypeptide variant, and particularly an H5 polypeptide variant, has an amino acid substitution relative to a wild type parent HA at residue 159.

In some embodiments, an HA polypeptide variant, and particularly an H5 polypeptide variant, has one or more amino acid substitutions relative to a wild type parent HA at residues selected from 190, 193, 225, and 226. In some embodiments, an HA polypeptide variant, and particularly an H5 polypeptide variant, has one or more amino acid substitutions relative to a wild type parent HA at residues selected from 190, 193, 226, and 228.

In some embodiments, a H5 HA polypeptide variant in accordance with the invention has one or more of the following amino acid substitutions: Ser132Thr, Ala133Thr, Ser133Thr, Ser137Ala, Ser137Arg, Ile155Thr, Lys156Glu, Asn158Xaa (wherein Xaa=any amino acid besides Asn), Thr160Ala, Asn186Pro, Asp187Ser, Asp187Thr, Ala188Glu, Ala188Asp, Ala189Gln, Ala189Lys, Ala189Thr, Glu190Asp, Glu190Thr, Thr192Arg/Lys, Lys193Arg, Lys193Asn, Lys193His, Lys193Ser, Lys/Arg193Thr/Ala/Met/Val, Ser221Pro, Gly225Asp, Gln226Ile, Gln226Leu, Gln226Val, Ser227Ala, Gly228Ser.

In some embodiments, an H5 HA polypeptide variant in accordance with the invention has an amino acid substitution at a position corresponding to residue 192, which switches the charge at that position. In some embodiments, an H5 HA polypeptide variant in accordance with the invention has an amino acid substitution at a position corresponding to residue 193, which switches the charge at that position. For example, in some embodiments, an H5 HA polypeptide in accordance with the invention has a Thr or a hydrophobic residue (e.g., Val or Ile) at a position corresponding to residue 192, and an H5 HA polypeptide variant (e.g., a human-adapted variant) has a hydrophilic residue at a position corresponding to residue 192. In some embodiments, an H5 HA polypeptide variant (e.g., a human-adapted variant) has a hydrophilic residue at a position corresponding to residue 192. To give another example, in some embodiments, an H5 HA polypeptide in accordance with the invention has a Thr or a hydrophobic residue (e.g., Val or Ile) at a position corresponding to residue 192, and an H5 HA polypeptide variant (e.g., a human-adapted variant) has a basic residue (e.g., Lys or Arg) at a position corresponding to residue 192. In some embodiments, an H5 HA polypeptide variant (e.g., a human-adapted variant) has a basic residue (e.g., Lys or Arg) at a position corresponding to residue 192. To give yet another example, in some embodiments, an H5 HA polypeptide in accordance with the invention has a basic residue (e.g., Lys or Arg) at a position corresponding to residue 193, and an H5 HA polypeptide variant (e.g., a human-adapted variant) has a neutral or acidic residue at a position corresponding to residue 193. In some embodiments, an H5 HA polypeptide variant (e.g., a human-adapted variant) has a neutral or acidic residue at a position corresponding to residue 193. In some embodiments, an H5 HA polypeptide variant (e.g., a human-adapted variant) has a Thr, Ala, Met, or Val at a position corresponding to residue 193.

In some embodiments, human adaptation of an H5 HA polypeptide is associated with the propert(ies) of the residue at position 188. In H5 HA, residue 188 is frequently Ala, which makes contacts with Thr or a hydrophobic residue at 192. In contrast, in H2 HA, residue 188 is frequently Glu or Asp, which makes contacts with Arg or Lys at 192. Hence, in some embodiments, an H5 HA polypeptide variant has a Glu at position 188. In some embodiments, an H5 HA polypeptide variant has an Asp at position 188. In some embodiments, an H5 HA polypeptide variant has an Ala188Glu substitution. In some embodiments, an H5 HA polypeptide variant has an Ala188Asp substitution.

In some embodiments, an H5 HA polypeptide has an Ala at a position corresponding to residue 188 and a Thr at a position corresponding to residue 192. In some embodiments, an H5 HA polypeptide has an Ala at a position corresponding to residue 188 and a hydrophobic residue at a position corresponding to residue 192. In some embodiments, an H5 HA polypeptide variant has a Glu at a position corresponding to residue 188 and an Arg at a position corresponding to residue 192. In some embodiments, an H5 HA polypeptide variant has an Asp at a position corresponding to residue 188 and an Arg at a position corresponding to residue 192. In some embodiments, an H5 HA polypeptide variant has a Glu at a position corresponding to residue 188 and a Lys at a position corresponding to residue 192. In some embodiments, an H5 HA polypeptide variant has an Asp at a position corresponding to residue 188 and a Lys at a position corresponding to residue 192.

In some embodiments, an H5 HA polypeptide has an Ala at a position corresponding to residue 188, a Thr at a position corresponding to residue 192, and a Lys at a position corresponding to residue 193. In some embodiments, an H5 HA polypeptide has an Ala at a position corresponding to residue 188, a hydrophobic residue at a position corresponding to residue 192, and a Lys at a position corresponding to residue 193. In some embodiments, an H5 HA polypeptide has an Ala at a position corresponding to residue 188, a Thr at a position corresponding to residue 192, and an Arg at a position corresponding to residue 193. In some embodiments, an H5 HA polypeptide has an Ala at a position corresponding to residue 188, a hydrophobic residue at a position corresponding to residue 192, and an Arg at a position corresponding to residue 193. In some embodiments, an H5 HA polypeptide variant has a Glu at a position corresponding to residue 188, an Arg at a position corresponding to residue 192, and a Thr at a position corresponding to residue 193. In some embodiments, an H5 HA polypeptide variant has an Asp at a position corresponding to residue 188, an Arg at a position corresponding to residue 192, and a Thr at a position corresponding to residue 193. In some embodiments, an H5 HA polypeptide variant has a Glu at a position corresponding to residue 188, a Lys at a position corresponding to residue 192, and a Thr at a position corresponding to residue 193. In some embodiments, an H5 HA polypeptide variant has an Asp at a position corresponding to residue 188, a Lys at a position corresponding to residue 192, and a Thr at a position corresponding to residue 193. In some embodiments, an H5 HA polypeptide variant has a Glu at a position corresponding to residue 188, an Arg at a position corresponding to residue 192, and a Thr, Ala, Met, or Val at a position corresponding to residue 193. In some embodiments, an H5 HA polypeptide variant has an Asp at a position corresponding to residue 188, an Arg at a position corresponding to residue 192, and a Thr, Ala, Met, or Val at a position corresponding to residue 193. In some embodiments, an H5 HA polypeptide variant has a Glu at a position corresponding to residue 188, a Lys at a position corresponding to residue 192, and a Thr, Ala, Met, or Val at a position corresponding to residue 193. In some embodiments, an H5 HA polypeptide variant has an Asp at a position corresponding to residue 188, a Lys at a position corresponding to residue 192, and a Thr, Ala, Met, or Val at a position corresponding to residue 193.

In some embodiments, an H5 HA polypeptide has an Ala at a position corresponding to residue 131. In some embodiments, an H5 HA polypeptide variant has a Thr at a position corresponding to residue 131.

In some embodiments, an H5 HA polypeptide has a Ser at a position corresponding to residue 132. In some embodiments, an H5 HA polypeptide variant has a Thr at a position corresponding to residue 132.

In some embodiments, an H5 HA polypeptide has a Ser at a position corresponding to residue 133. In some embodiments, an H5 HA polypeptide variant has a Thr at a position corresponding to residue 133.

In some embodiments, an H5 HA polypeptide includes Ala, Thr, and/or Ser at any position corresponding to residues 131, 132, and/or 133. In some embodiments, an H5 HA polypeptide variant includes Ala, Thr, and/or Ser at any position corresponding to residues 131, 132, and/or 133. In some embodiments, an H5 HA polypeptide variant includes Thr at all of positions corresponding to residues 131, 132, and 133.

In some embodiments, an H5 HA polypeptide has a Val at a position corresponding to residue 135. In some embodiments, an H5 HA polypeptide variant has any amino acid other than Val at a position corresponding to residue 135.

In some embodiments, an H5 HA polypeptide has a Ser at a position corresponding to residue 137. In some embodiments, an H5 HA polypeptide variant has an Arg at a position corresponding to residue 137.

In some embodiments, an H5 HA polypeptide has an Ile at a position corresponding to residue 155. In some embodiments, an H5 HA polypeptide variant has a Thr at a position corresponding to residue 155. In some embodiments, an H5 HA polypeptide includes a Thr at a position corresponding to residue 155. In some embodiments, an H5 HA polypeptide variant includes a Thr at a position corresponding to residue 155.

In some embodiments, an H5 HA polypeptide has a Ser at a position corresponding to residue 221. In some embodiments, an H5 HA polypeptide variant has a Pro at a position corresponding to residue 221.

In some embodiments, an H5 HA polypeptide includes a Ser at a position corresponding to residue 221. In some embodiments, an H5 HA polypeptide variant includes a Pro at a position corresponding to residue 221. Without wishing to be bound by any one particular theory, Pro221 might influence conformation of 220 loop which is involved with the RBS of H2 HA.

In some embodiments, an H5 HA polypeptide has a Gln at a position corresponding to residue 226. In some embodiments, an H5 HA polypeptide variant has a Leu at a position corresponding to residue 226.

In some embodiments, an H5 HA polypeptide has a Ser at a position corresponding to residue 227. In some embodiments, an H5 HA polypeptide variant has a Gly at a position corresponding to residue 227.

In some embodiments, an H5 HA polypeptide has a Gly at a position corresponding to residue 228. In some embodiments, an H5 HA polypeptide variant has a Ser at a position corresponding to residue 228.

In some embodiments, an H5 HA polypeptide includes Gln, Ser, and Gly residues at positions 226, 227, and 228, respectively. In some embodiments, an H5 HA polypeptide variant includes a Leu, Gly, and Ser at positions 226, 227, and 228, respectively.

In some embodiments, a H5 HA polypeptide variant in accordance with the invention has one or more of the following amino acids at the indicated positions:

Glu190Asp, Lys193Ser, Gly225Asp, Gln226Leu
Glu190Asp, Lys193Ser, Gln226Leu, Gly228Ser
Ala189Gln, Lys193Ser, Thr160Ala
Ala189Gln, Lys193Ser, Gln226Leu, Gly228Ser
Asp187Ser/Thr, Ala189Gln, Lys193Ser, Gln226Leu, Gly228Ser
Ala189Lys, Lys193Asn, Gln226Leu, Gly228Ser
Asp187Ser/Thr, Ala189Lys, Lys193Asn, Gln226Leu, Gly228Ser
Lys156Glu, Ala189Lys, Lys193Asn, Gln226Leu, Gly228Ser
Lys193His, Gln226Leu/Ile/Val, Gly228Ser
Lys193Arg, Gln226Leu/Ile/Val, Gly228Ser
Ala189Lys, Lys193Asn, Gly225Asp
Lys156Glu, Ala189Lys, Lys193Asn, Gly225Asp
Ser137Ala, Lys156Glu, Ala189Lys, Lys193Asn, Gly225Asp
Glu190Thr, Lys193Ser, Gly225Asp
Asp187Thr, Ala189Thr, Glu190Asp, Lys193Ser, Gly225Asp
Asn186Pro, Asp187Thr, Ala189Thr, Glu190Asp, Lys193Ser, Gly225Asp
Asn186Pro, Asp187Thr, Ala189Thr, Glu190Asp, Lys193Ser, Gly225Asp, Ser227Ala
Gln226Leu, Gly228Ser, Thr160Ala
Gln226Leu, Gly228Ser, Thr160Ala
Gly228Ser, Thr160Ala
Gln226Leu, Thr160Ala
Gln226Leu, Gly228Ser
Thr160Ala
Gln226Leu, Gly228Ser, Asn158Xaa (wherein Xaa=any amino acid besides Asn)
Gly228Ser, Asn158Xaa
Gln226Leu, Asn158Xaa
Gln226Leu, Gly228Ser
Asn158Xaa
Δ130 (wherein "Δ130" indicates a deletion at an amino acid corresponding to position 130) plus any possible combination of mutations at positions corresponding to 131, 132, 133, 135, 137, 155, 188, 192, 193, 221, 226, 227, and 228
Δ130 plus any possible combination of mutations at positions corresponding to 131, 132, 135, 188, 192, and 221
Δ130 plus any possible combination of mutations at positions corresponding to 133, 137, 155, 193, 226, 227, and 228
Δ130 plus any possible combination of mutations at positions corresponding to 131, 132, 133, 135, 137, 155, 158, 160, 188, 192, 193, 221, 226, 227, and 228
Δ130 plus any possible combination of mutations at positions corresponding to 131, 133, 137, 155, 188, 192, 193, 226, 227, and 228
Δ130 plus any possible combination of mutations at positions corresponding to 131, 133, 137, 155, 188, 192, 193, 226, and 228
Δ130 plus any possible combination of mutations at positions corresponding to 131, 133, 137, 155, 159, 160, 188, 192, 193, 226, 227, and 228
Δ130 plus any possible combination of mutations at positions corresponding to 131, 133, 137, 155, 159, 160, 188, 192, 193, 226, and 228
Δ130 plus any possible combination of mutations at positions corresponding to 137, 188, 192, 193, 226, 228, 131, 132, 133, 221, and 227
Δ130 plus any possible combination of mutations at positions corresponding to 131, 132, 133, 221, and 227
Δ130 plus any possible combination of mutations at positions corresponding to 137, 188, 192, 193, 226, and 228
Δ130 plus any possible combination of mutations at positions corresponding to 137, 188, 192, 193, 226, 227, 228, 131, 132, and 133
Δ130 plus any possible combination of mutations at positions corresponding to 227, 131, 132, and 133
Gln226Leu, Gly228Ser, Thr160Ala, Δ130
Gln226Leu, Gly228Ser, Δ130
Gln226Leu, Thr160Ala, Δ130
Gly228Ser, Thr160Ala, Δ130
Gln226Leu, Δ130
Gly228Ser, Δ130
Thr160Ala, Δ130
Δ130
Δ130, Ala131Thr, Leu133Thr, Ser137Arg, Ile155Thr, Ala188Glu, Thr/Ile192Arg/Lys, Arg/Lys193Thr/Ala, Gln226Leu, Ser227Gly, Gly228Ser Δ130, Ala131Thr, Leu133Thr, Ser137Arg, Ile155Thr, Ala188Glu, Thr/Ile192Arg/Lys, Arg/Lys193Thr/Ala, Gln226Leu, Gly228Ser Δ130, Ala131Thr, Leu133Thr, Ser137Arg, Ile155Thr, Asn159Asp (or Thr160Ala or both), Ala188Glu, Thr/Ile192Arg/Lys, Arg/Lys193Thr/Ala, Gln226Leu, Ser227Gly, Gly228Ser Δ130, Ala131Thr, Leu133Thr, Ser137Arg, Ile155Thr, Asn159Asp (or Thr160Ala or both), Ala188Glu, Thr/Ile192Arg/Lys, Arg/Lys193Thr/Ala, Gln226Leu, Gly228Ser Δ130, Ser137Arg, Ala188Glu, Thr192Arg/Lys, Arg/Lys193Thr/Met/Ala/Val, Gln226Leu, Gly228Ser Δ130, Ser137Arg, Ala188Glu, Thr192Arg/Lys, Arg/Lys193Thr/Met/Ala/Val, Gln226Leu, Gly228Ser, Xaa131Ser/Thr, Xaa132Ser/Thr, Xaa133Ser/Thr, Ser221Pro, Ser227Gly (wherein Xaa=any amino acid)

Δ130, Xaa131Ser/Thr, Xaa132Ser/Thr, Xaa133Ser/Thr, Ser221Pro, Ser227Gly (wherein Xaa=any amino acid)

Δ130, Xaa192Xaa' (wherein Xaa=any hydrophobic amino acid, and Xaa'=any hydrophilic amino acid)

Δ130, Xaa192Lys/Arg (wherein Xaa=any hydrophobic residue)

Δ130, Xaa193Xaa' (wherein Xaa=a basic residue, e.g., Lys or Arg, and Xaa'=a neutral or acidic residue)

Δ130, Lys/Arg193Thr/Ala/Met/Val

Δ130, Xaa192Xaa' (wherein Xaa=any hydrophobic amino acid, and Xaa'=any hydrophilic amino acid), Xaa193Xaa' (wherein Xaa=a basic residue, e.g., Lys or Arg, and Xaa'=a neutral or acidic residue)

Δ130, Xaa192Lys/Arg (wherein Xaa=any hydrophobic residue), Xaa193Xaa' (wherein Xaa=a basic residue, e.g., Lys or Arg, and Xaa'=a neutral or acidic residue)

Δ130, Xaa192Xaa' (wherein Xaa=any hydrophobic amino acid, and Xaa'=any hydrophilic amino acid), Lys/Arg193Thr/Ala/Met/Val Δ130, Xaa192Lys/Arg (wherein Xaa=any hydrophobic residue), Lys/Arg193Thr/Ala/Met/Val Δ130, Ala188Glu Δ130, Ala188Asp Δ130, Xaa192Xaa' (wherein Xaa=any hydrophobic amino acid, and Xaa'=any hydrophilic amino acid), Ala188Glu Δ130, Xaa192Lys/Arg (wherein Xaa=any hydrophobic residue), Ala188Glu Δ130, Xaa193Xaa' (wherein Xaa=a basic residue, e.g., Lys or Arg, and Xaa'=a neutral or acidic residue), Ala188Glu Δ130, Lys/Arg193Thr/Ala/Met/Val, Ala188Glu Δ130, Xaa192Xaa' (wherein Xaa=any hydrophobic amino acid, and Xaa'=any hydrophilic amino acid), Ala188Asp Δ130, Xaa192Lys/Arg (wherein Xaa=any hydrophobic residue), Ala188Asp Δ130, Xaa193Xaa' (wherein Xaa=a basic residue, e.g., Lys or Arg, and Xaa'=a neutral or acidic residue), Ala188Asp Δ130, Lys/Arg193Thr/Ala/Met/Val, Ala188Asp Δ130, Xaa192Xaa' (wherein Xaa=any hydrophobic amino acid, and Xaa'=any hydrophilic amino acid), Xaa193Xaa' (wherein Xaa=a basic residue, e.g., Lys or Arg, and Xaa'=a neutral or acidic residue), Ala188Glu Δ130, Xaa192Lys/Arg (wherein Xaa=any hydrophobic residue), Xaa193Xaa' (wherein Xaa=a basic residue, e.g., Lys or Arg, and Xaa'=a neutral or acidic residue), Ala188Glu Δ130, Xaa192Xaa' (wherein Xaa=any hydrophobic amino acid, and Xaa'=any hydrophilic amino acid), Lys/Arg193Thr/Ala/Met/Val, Ala188Glu Δ130, Xaa192Lys/Arg (wherein Xaa=any hydrophobic residue), Lys/Arg193Thr/Ala/Met/Val, Ala188Glu Δ130, Xaa192Xaa' (wherein Xaa=any hydrophobic amino acid, and Xaa'=any hydrophilic amino acid), Xaa193Xaa' (wherein Xaa=a basic residue, e.g., Lys or Arg, and Xaa'=a neutral or acidic residue), Ala188Asp Δ130, Xaa192Lys/Arg (wherein Xaa=any hydrophobic residue), Xaa193Xaa' (wherein Xaa=a basic residue, e.g., Lys or Arg, and Xaa'=a neutral or acidic residue), Ala188Asp Δ130, Xaa192Xaa' (wherein Xaa=any hydrophobic amino acid, and Xaa'=any hydrophilic amino acid), Lys/Arg193Thr/Ala/Met/Val, Ala188Asp Δ130, Xaa192Lys/Arg (wherein Xaa=any hydrophobic residue), Lys/Arg193Thr/Ala/Met/Val, Ala188Asp In some embodiments, the present invention provides H5 HA polypeptides (e.g., H5 HA polypeptide variants, engineered H5 HA polypeptides, and/or engineered H5 HA polypeptide variants) whose amino acid sequence includes an element as set forth below (the numbering of these positions corresponds to the numbering of H3 HA):

X190, X193, X225 and X226
X190, X193, X226 and X228
X189, X193, X160
X189, X193, X226, X228
X187, X189, X193, X226, X228
X189, X193, X226, X228
X187, X189, X193, X226, X228
X156, X189, X193, X226, X228
X193, X226, X228
X193, X226, X228
X189, X193, X225
X156, X189, X193, X225
X137, X156, X189, X193, X225
X190, X193, X225
X187, X189, X190, X193, X225
X186, X187, X189, X190, X193, X225
X186, X187, X189, X190, X193, X225, X227
X226, X228, X160
X226, X228, X160
X228, X160
X226, X160
X226, X228
X160
X226, X228, Xaa158 (wherein Xaa=any amino acid besides Asn)
X228, Xaa158 (wherein Xaa=any amino acid besides Asn)
X226, Xaa158 (wherein Xaa=any amino acid besides Asn)
X226, X228
X158 (wherein Xaa=any amino acid besides Asn)
X130 plus any possible combination of X131, X132, X133, X135, X137, X155, X188, X192, X193, X221, X226, X227, and X228
X130 plus any possible combination of X131, X132, X135, X188, X192, and X221
X130 plus any possible combination of X133, X137, X155, X193, X226, X227, and X228
X130 plus any possible combination of X131, X132, X133, X135, X137, X155, Xaa158 (wherein Xaa=any amino acid besides Asn), X160, X188, X192, X193, X221, X226, X227, and X228

X130 plus any possible combination of X131, X133, X137, X155, X188, X192, X193, X226, X227, and X228

X130 plus any possible combination of X131, X133, X137, X155, X188, X192, X193, X226, and X228

X130 plus any possible combination of X131, X133, X137, X155, X159, X160, X188, X192, X193, X226, X227, and X228

X130 plus any possible combination of X131, X133, X137, X155, X159, X160, X188, X192, X193, X226, and X228

X130 plus any possible combination of X137, X188, X192, X193, X226, X228, X131, X132, X133, X221, and X227

X130 plus any possible combination of X131, X132, X133, X221, and X227

X130 plus any possible combination of X137, X188, X192, X193, X226, and X228

X130 plus any possible combination of X137, X188, X192, X193, X226, X227, X228, X131, X132, and X133

X130 plus any possible combination of X227, X131, X132, and X133

X226, X228, X160, X130

X226, X228, X130

X226, X160, X130

X228, X160, X130

X226, X130

X228, X130

X160, X130

X130

X130, X131, X133, X137, X155, X188, X192, X193, X226, X227, X228

X130, X131, X133, X137, X155, X188, X192, X193, X226, X228

X130, X131, X133, X137, X155, X159, X160, X188, X192, X193, X226, X227, X228

X130, X131, X133, X137, X155, X159, X160, X188, X192, X193, X226, X228

X130, X137, X188, X192, X193, X226, X228

X130, X137, X188, X192, X193, X226, X228, X131, X132, X133, X221, X227

X130, X131, X132, X133, X221, X227

X130, X192

X130, X193

X130, X192, X193

X130, X188

X130, X192, X188

X130, X193, X188

X130, X192, X193, X188 wherein X=any amino acid (unless otherwise specified above), and/or X=a missing amino acid. The numbering of these positions corresponds to the numbering of H3 HA.

In some embodiments X130 is a deletion at a site corresponding to position 130. In some embodiments, X160 is an Ala. In some embodiments, X158 is any amino acid other than Asn.

In some such embodiments, the H5 HA polypeptide variant has at least one further substitution as compared with a wild type H5 HA, such that affinity and/or specificity of the variant for umbrella glycans is increased.

In some embodiments, H5 HA polypeptide variants in accordance with the invention (including H5 HA polypeptide variants) have sequences that include L226, S228, and A160. In some embodiments, H5 HA polypeptide variants in accordance with the invention (including H5 HA polypeptide variants) have sequences that include L226 and A160. In some embodiments, H5 HA polypeptide variants in accordance with the invention (including H5 HA polypeptide variants) have sequences that include S228 and A160. In some embodiments, H5 HA polypeptide variants in accordance with the invention (including H5 HA polypeptide variants) have sequences that include A160.

In some embodiments, H5 HA polypeptide variants in accordance with the invention (including H5 HA polypeptide variants) have sequences that include L226, S228, and X158 (wherein X=any amino acid besides Asn). In some embodiments, H5 HA polypeptide variants in accordance with the invention (including H5 HA polypeptide variants) have sequences that include L226 and X158. In some embodiments, H5 HA polypeptide variants in accordance with the invention (including H5 HA polypeptide variants) have sequences that include S228 and X158. In some embodiments, H5 HA polypeptide variants in accordance with the invention (including H5 HA polypeptide variants) have sequences that include X158.

In some embodiments, H5 HA polypeptide variants in accordance with the invention (including H5 HA polypeptide variants) have sequences that include Δ130 and any possible combination of mutations at positions corresponding to 131, 132, 133, 135, 137, 155, 158, 160, 188, 192, 193, 221, 226, 227, and 228.

In some embodiments, H5 HA polypeptide variants in accordance with the invention (including H5 HA polypeptide variants) have sequences that include Δ130, L226, S228, A160 and any possible combination of mutations at positions corresponding to 131, 132, 133, 135, 137, 155, 158, 188, 192, 193, 221, and 227. In some embodiments, H5 HA polypeptide variants in accordance with the invention (including H5 HA polypeptide variants) have sequences that include Δ130, L226, A160, and any possible combination of mutations at positions corresponding to 131, 132, 133, 135, 137, 155, 158, 188, 192, 193, 221, 227, and 228. In some embodiments, H5 HA polypeptide variants in accordance with the invention (including H5 HA polypeptide variants) have sequences that include Δ130, S228, A160, and any possible combination of mutations at positions corresponding to 131, 132, 133, 135, 137, 155, 158, 188, 192, 193, 221, and 227. In some embodiments, H5 HA polypeptide variants in accordance with the invention (including H5 HA polypeptide variants) have sequences that include Δ130, L226, S228, and any possible combination of mutations at positions corresponding to 131, 132, 133, 135, 137, 155, 158, 160, 188, 192, 193, 221, and 227.

In some embodiments, H5 HA polypeptide variants in accordance with the invention (including H5 HA polypeptide variants) have sequences that include Δ130, A160, and any possible combination of mutations at positions corresponding to 131, 132, 133, 135, 137, 155, 158, 188, 192, 193, 221, 226, 227, and 228. In some embodiments, H5 HA polypeptide variants in accordance with the invention (including H5 HA polypeptide variants) have sequences that include Δ130, L226, and any possible combination of mutations at positions corresponding to 131, 132, 133, 135, 137, 155, 158, 160, 188, 192, 193, 221, and 227, and 228. In some embodiments, H5 HA polypeptide variants in accordance with the invention (including H5 HA polypeptide variants) have sequences that include Δ130, S228, and any possible combination of mutations at positions corresponding to 131, 132, 133, 135, 137, 155, 158, 160, 188, 192, 193, 221, 226, and 227.

In some embodiments, H5 HA polypeptides in accordance with the invention (including H5 HA polypeptide variants)

have sequences that include Δ130, L226, S228, X158 (wherein X=any amino acid besides Asn) and any possible combination of mutations at positions corresponding to 131, 132, 133, 135, 137, 155, 160, 188, 192, 193, 221, and 227. In some embodiments, H5 HA polypeptides in accordance with the invention (including H5 HA polypeptide variants) have sequences that include Δ130, L226, X158, and any possible combination of mutations at positions corresponding to 131, 132, 133, 135, 137, 155, 160, 188, 192, 193, 221, 227, and 228. In some embodiments, H5 HA polypeptides in accordance with the invention (including H5 HA polypeptide variants) have sequences that include Δ130, S228, X158, and any possible combination of mutations at positions corresponding to 131, 132, 133, 135, 137, 155, 160, 188, 192, 193, 221, and 227. In some embodiments, H5 HA polypeptides in accordance with the invention (including H5 HA polypeptide variants) have sequences that include Δ130, L226, S228, and any possible combination of mutations at positions corresponding to 131, 132, 133, 135, 137, 155, 158, 160, 188, 192, 193, 221, and 227.

In some embodiments, H5 HA polypeptides in accordance with the invention (including H5 HA polypeptide variants) have sequences that include Δ130, X158 (wherein X=any amino acid besides Asn), and any possible combination of mutations at positions corresponding to 131, 132, 133, 135, 137, 155, 160, 188, 192, 193, 221, 226, 227, and 228.

In some embodiments, H5 HA polypeptide variants in accordance with the invention have an open binding site as compared with a parent H5 HA, and particularly with a parent wild type H5 HAs.

In some embodiments, H5 HA polypeptides in accordance with the invention bind to the following α2-6 sialylated glycans:

[glycan structures]

and combinations thereof. In some embodiments, H5 HA polypeptides in accordance with the invention bind to glycans of the structure:

[glycan structures]

and combinations thereof; and/or

[glycan structure]

and/or

[glycan structure]

and/or

[glycan structures]

and combinations thereof. In some embodiments, H5 HA polypeptides in accordance with the invention bind to

[glycan structures]

and/or

[glycan structure]

in some embodiments to

[glycan structure]

in some embodiments to

[glycan structure]

and in some embodiments to

[glycan structures]

and/or

[glycan structure]

In some embodiments, H5 HA polypeptides in accordance with the invention bind to umbrella topology glycans. In some embodiments, H5 HA polypeptides in accordance with the invention bind to at least some of the glycans (e.g., α2-6 sialylated glycans) depicted in FIG. 9. In some embodiments, H5 HA polypeptides in accordance with the invention bind to multiple glycans depicted in FIG. 9.

In some embodiments, H5 HA polypeptides in accordance with the invention bind to at least about 10%, about 15%, about 20%, about 25%, about 30% about 35%, about 40%, about 45%, about 50%, about 55%, about 60%, about 65%, about 70%, about 75%, about 80%, about 85%, about 90% about 95%, or more of the glycans found on HA receptors in human upper respiratory tract tissues (e.g., epithelial cells).

In some embodiments, H5 HA polypeptides (including H5 HA polypeptide variants) are any of those set forth in SEQ ID NOs: 50, 51, 53-55,-60-75 and 205-206.

In one aspect, the present invention provides the particular recognition that high affinity binding to umbrella-topology glycans alone may not be sufficient to confer effective transmission to/infectivity of humans. The present invention provides the insight that reduced binding to cone-topology glycans may also be important. In some embodiments, high affinity binding to umbrella-topology glycans and reduced affinity binding to cone-topology glycans may be involved in conferring effective transmission to/infectivity of humans. In some embodiments, high affinity binding to umbrella-topology glycans is sufficient to confer effective transmission to/infectivity of humans. In some embodiments, high affinity binding to umbrella-topology glycans is sufficient to confer effective transmission to/infectivity of humans, even if the affinity of binding to cone-topology glycans is not reduced (e.g., unchanged, increased, etc.).

In some embodiments, increased affinity and/or specificity of binding of an H5 HA polypeptide variant to umbrella-topology glycans and reduced affinity and/or specificity binding to cone-topology glycans may be involved in increasing or enhancing transmission to/infectivity of humans relative to a reference polypeptide (e.g., the H5 HA polypeptide variant's cognate parent HA polypeptide). In some embodiments, increased affinity and/or specificity of binding of an H5 HA polypeptide variant to umbrella-topology glycans is sufficient to increase or enhance transmission to/infectivity of humans relative to a reference polypeptide (e.g., the H5 HA polypeptide variant's cognate parent HA polypeptide). In some embodiments, increased affinity and/or specificity of binding of an H5 HA polypeptide variant to umbrella-topology glycans is sufficient to increase or enhance transmission to/infectivity of humans relative to a reference polypeptide (e.g., the H5 HA polypeptide variant's cognate parent HA polypeptide), even if the affinity and/or specificity of binding to cone-topology glycans is not reduced (e.g., unchanged, increased, etc.). In some embodiments, increased affinity and/or specificity of binding of an H5 HA polypeptide variant to umbrella-topology glycans is sufficient to increase or enhance transmission to/infectivity of humans relative to a reference polypeptide (e.g., the H5 HA polypeptide variant's cognate parent HA polypeptide), even if the affinity and/or specificity of binding to cone-topology glycans is equal to and/or greater than that of the affinity and/or specificity of binding to umbrella-topology glycans.

Example 3: Glycan Diversity in Human Upper Respiratory Tissues

Figure 12A:
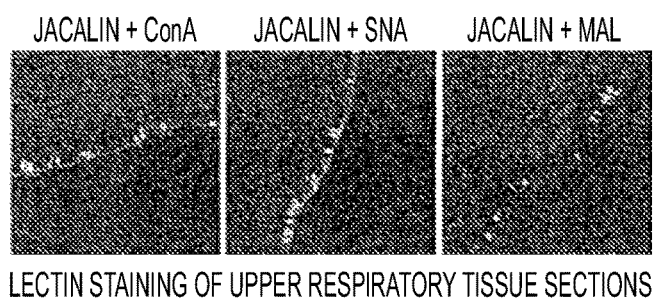
FIG. 12A-B. Lectin staining of upper respiratory tissue sections. A co-stain of the tracheal tissue with Jacalin (lighter) and ConA (darker) reveals a preferential binding of Jacalin (binds specifically to O-linked glycans) to goblet cells on the apical surface of the trachea and ConA (binds specifically to N-linked glycans) to the ciliated tracheal epithelial cells. Without wishing to be bound by any particular theory, we note that this finding suggests that goblet cells predominantly express O-linked glycans while ciliated epithelial cells predominantly express N-linked glycans. Co-staining of trachea with Jacalin and SNA (dark; binds specifically to α2-6) shows binding of SNA to both goblet and ciliated cells. On the other hand, co-staining of Jacalin (lighter) and MAL (darker), which specifically binds to α2-3 sialylated glycans, shows weak minimal to no binding of MAL to the pseudostratified tracheal epithelium but extensive binding to the underlying regions of the tissue. Together, the lectin staining data indicated predominant expression and extensive distribution of α2-6 sialylated glycans as a part of both N-linked and O-linked glycans respectively in ciliated and goblet cells on the apical side of the tracheal epithelium.
Figure 12B:
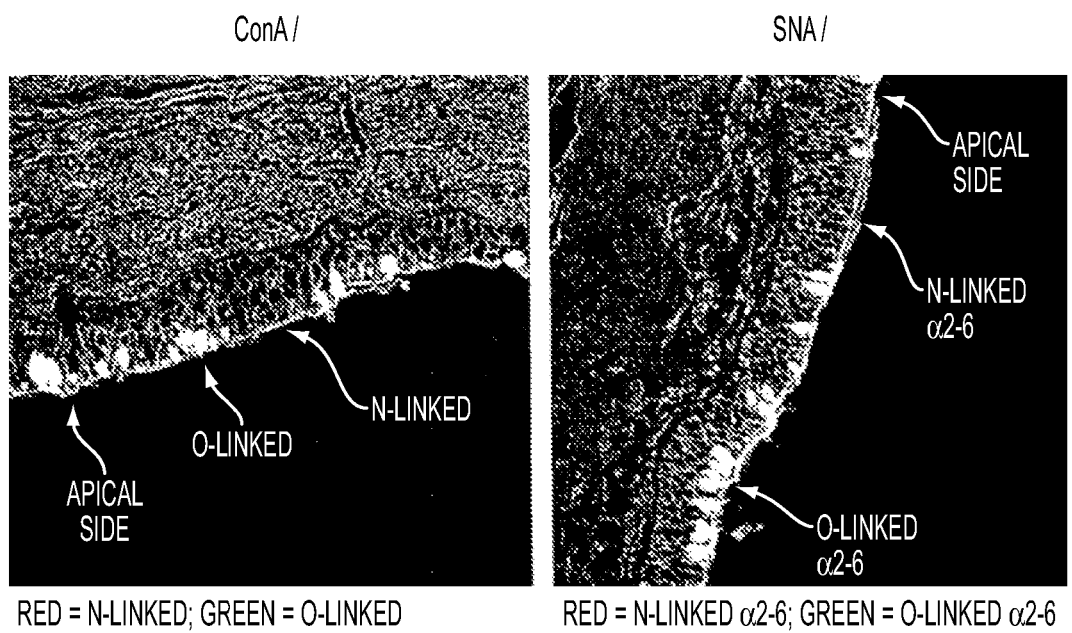

Lectin binding studies showed diversity in the distribution of α2-3 and α2-6 in the upper respiratory tissues. Staining studies indicate predominant distribution of α2-6 sialylated glycans as a part of both N-linked (ciliated cells) and O-linked glycans (in the goblet cells) on the apical side of the tracheal epithelium (FIG. 12). On the other hand, the internal regions of the tracheal tissue predominantly comprises of α2-3 distributed on N-linked glycans.

Figure 10A:
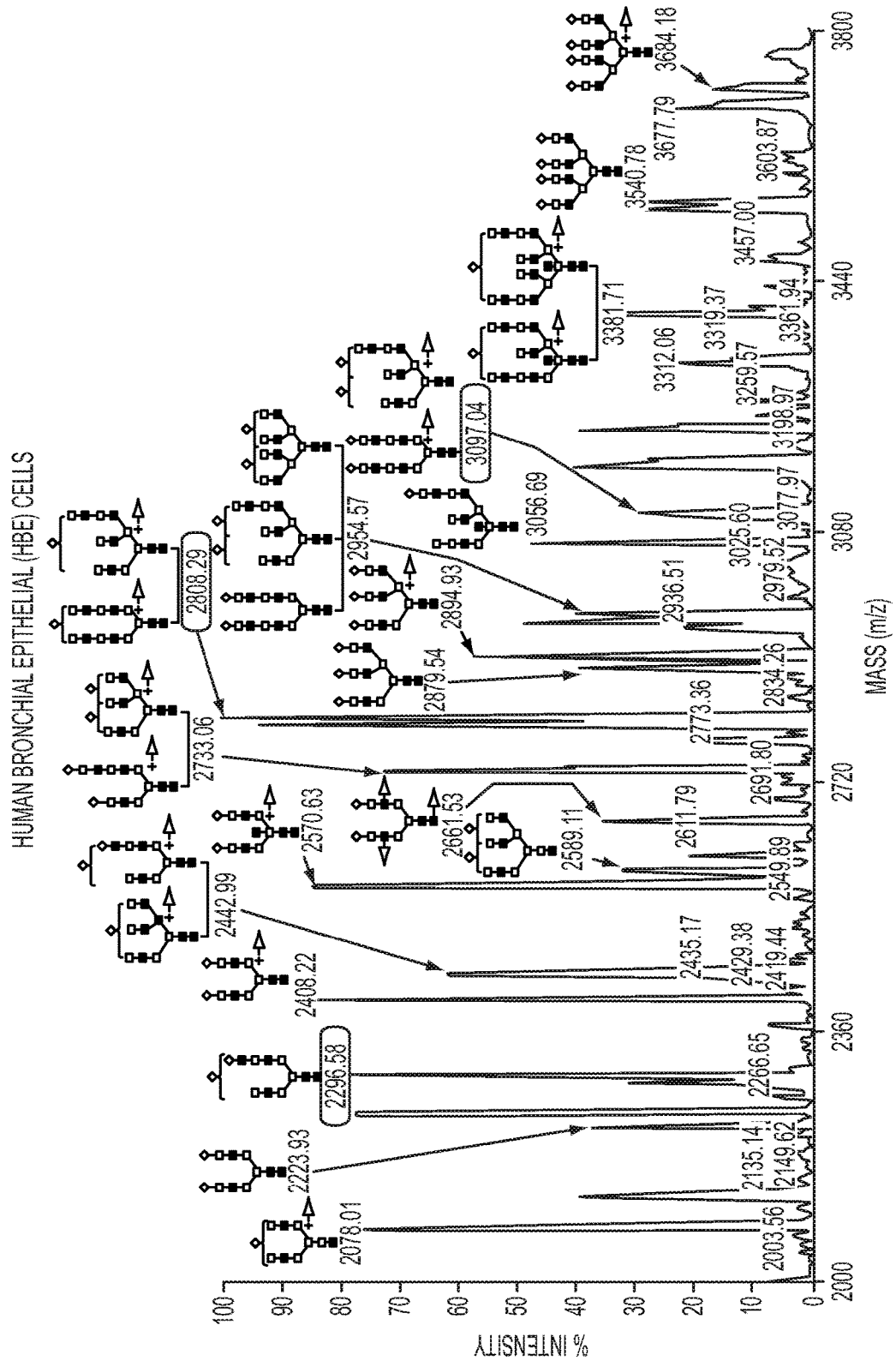
FIG. 10A-B. Glycan profile of human bronchial epithelial cells and human colonic epithelial cells. To further investigate the glycan diversity in the upper respiratory tissues, N-linked glycans were isolated from HBEs (a representative upper respiratory cell line) and analyzed using MALDI-MS. The predominant expression of α2-6 in HBEs was confirmed by pre-treating the sample with Sialidase S (α2-3 specific) and Sialidase A (cleaves and SA). The predominant expression of glycans with long branch topology is supported by TOF-TOF fragmentation analysis of representative mass peaks. To provide a reference for glycan diversity in the upper respiratory tissues, the N-linked glycan profile of human colonic epithelial cells (HT29; a representative gut cell line) was obtained. This cell line was chosen because the current H5N1 viruses have been shown to infect gut cells. Sialidase A and S pre-treatment controls showed predominant expression of α2-3 glycans in the HT-29 cells. Moreover, the long branch glycan topology is not as prevalent as observed for HBEs. Therefore, human adaptation of the H5N1 HA would involve HA mutations that would enable high affinity binding to the diverse glycans expressed in the human upper respiratory tissues (e.g., umbrella glycans).
Figure 10B:
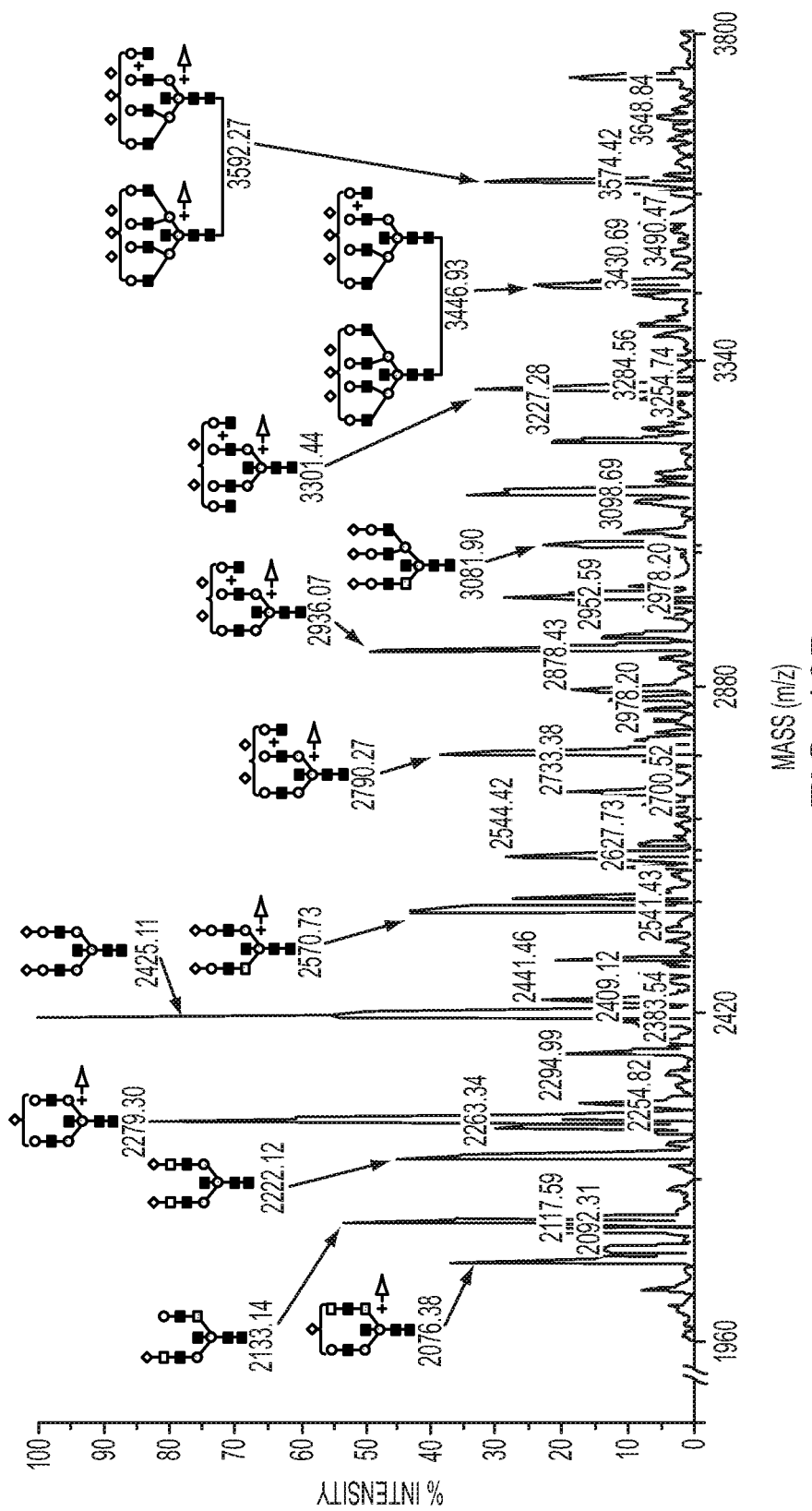
Figure 11A:
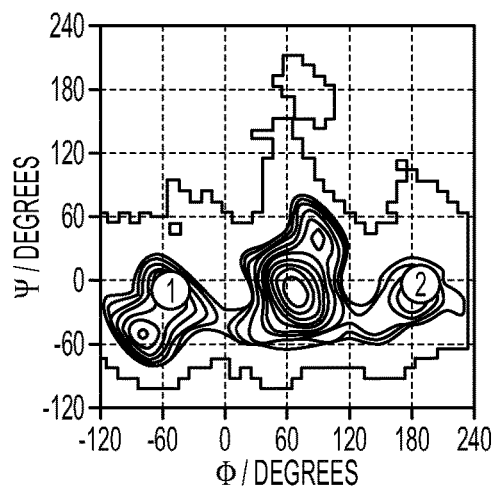
FIG. 11. Conformational map and solvent accessibility of Neu5Acα2-3Gal and Neu5Acα2-6Gal motifs. Panel A shows the conformational map of Neu5Acα2-3Gal linkage. The encircled region 2 is the trans conformation observed in the APR34_H1_23, ADU63_H3_23 and ADS97_H5_23 co-crystal structures. The encircled region 1 is the conformation observed in the AAI68_H3_23 co-crystal structure. Panel B shows the conformational map of Neu5Acα2-6Gal where the cis-conformation (encircled region 3) is observed in all the HA-α2-6 sialylated glycan co-crystal structures. Panel C shows difference between solvent accessible surface area (SASA) of Neu5Ac α2-3 and α2-6 sialylated oligosaccharides in the respective HA-glycan co-crystal structures. The red and cyan bars respectively indicate that Neu5Ac in α2-6 (positive value) or α2-3 (negative value) sialylated glycans makes more contact with glycan binding site. Panel D shows difference between SASA of NeuAc in α2-3 sialylated glycans bound to swine and human H1 ($H1_{\alpha 2-3}$), avian and human H3 ($H3_{\alpha 2-3}$), and of NeuAc in α2-6 sialylated glycans bound to swine and human H1 ($H1_{\alpha 2-6}$). The negative bar for $H3_{\alpha 2-3}$ indicates lesser contact of the human H3 HA with Neu5Acα2-3Gal compared to that of avian H3. Torsion angles—φ: C2-C1-O—C3 (for Neu5Acα2-3/6 linkage); ψ: C1-O—C3-H3 (for Neu5Acα2-3Gal) or C1-O—C6-C5 (for Neu5Acα2-6Gal); ω: O—C6-C5-H5 (for Neu5Acα2-6Gal) linkages. The φ, ψ maps were obtained from GlycoMaps DB (available through the world wide web at glycosciences.de/modeling/glycomapsdb/) which was developed by Dr. Martin Frank and Dr. Claus-Wilhelm von der Lieth (German Cancer Research Institute, Heidelberg, Germany). The coloring scheme from high energy to low energy is from bright red to bright green, respectively.
Figure 11B:
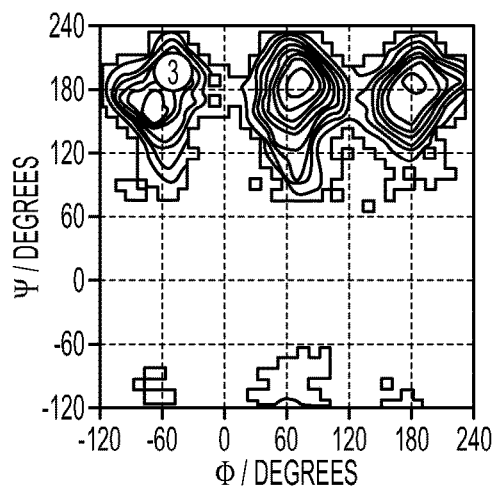
Figure 11C:
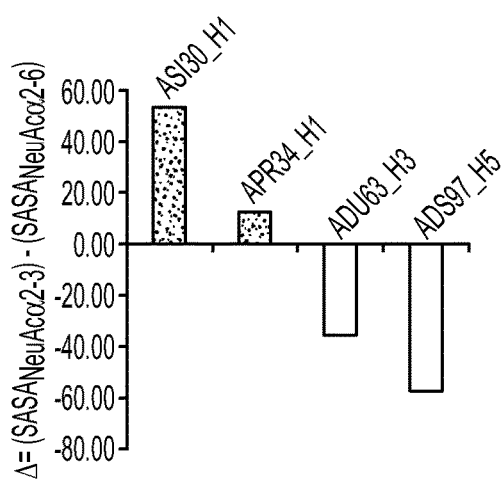
Figure 11D:
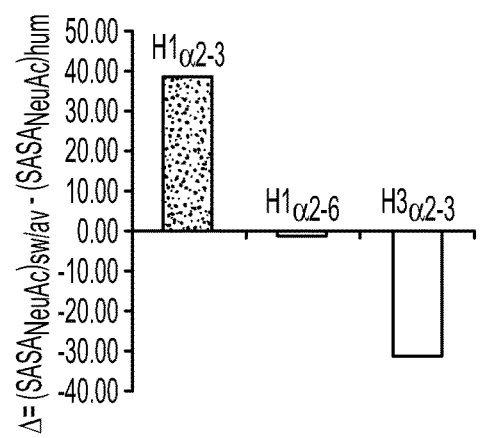

MALDI-MS glycan profiling analyses showed a substantial diversity (FIG. 10) as well as predominant expression of α2-6 sialylated glycans on the human upper airways. Fragmentation of representative mass peaks using MALDI TOF-TOF supports glycan topologies where longer oligosaccharide branches with multiple lactosamine repeats are extensively distributed as compared to short oligosaccharide branches (FIG. 10). To provide a reference for the diversity in the distribution and topology of glycans in the upper airway, MALDI-MS analysis was performed on N-linked glycans from human colonic epithelial cells (HT29). Recent H5N1 viruses have primarily infected the gut, and hence, these cells were chosen as representative gut cells. The glycan profile of HT29 cells is significantly different from that of the HBEs wherein there is a predominant distribution of α2-3 and the long oligosaccharide branch glycan topology is not as observed (FIG. 10).

Data in FIG. 12 were generated by the following method. Formalin fixed and paraffin embedded human tracheal tissue sections were purchased from US Biological. After the tissue sections were deparaffinized and rehydrated, endogenous biotin was blocked using the streptavidin/biotin blocking kit (Vector Labs). Sections were then incubated with FITC labeled Jacalin (specific for O-linked glycans), biotinylated Concanavalin A (Con A, specific for α-linked mannose residues, which are part of the core oligosaccharide structure that constitute N-linked glycans), biotinylated *Maackia amurensis* lectin (MAL, specific for SAα2,3-gal) and biotinylated *Sambuccus nigra* agglutinin (SNA, specific for SAα2,6-gal) (Vector labs; 10 μg/ml in PBS with 0.5% Tween-20) for 3 hrs. After washing with TBST (Tris buffered saline with 1% Tween-20), the sections were incubated with Alexa fluor 546 streptavidin (2 μg/ml in PBS with 0.5% Tween-20) for 1 hr. Slides were washed with TBST and viewed under a confocal microscope (Zeiss LSM510 laser scanning confocal microscopy). All incubations were performed at room temperature (RT).

Data in FIG. 10 were generated using the following method. The cells (~70×10$^6$) were harvested when they were >90% confluent with 100 mM citrate saline buffer and the cell membrane was isolated after treatment with protease inhibitor (Calbiochem) and homogenization. The cell membrane fraction was treated with PNGaseF (New England Biolabs) and the reaction mixture was incubated overnight at 37° C. The reaction mixture was boiled for 10 min to deactivate the enzyme and the deglycosylated peptides and proteins were removed using a Sep-Pak C18 SPE cartridge (Waters). Glycans were further desalted and purified into neutral (25% acetonitrile fraction) and acidic (50% acetonitrile containing 0.05% trifluoroacetic acid) fractions using graphitized carbon solid-phase extraction columns (Supelco). Acidic fractions were analyzed by MALDI-TOF MS in positive and negative modes respectively with soft ionization conditions (accelerating voltage 22 kV, grid voltage 93%, guide wire 0.3% and extraction delay time of 150 ns). The peaks were calibrated as non-sodiated species. The predominant expression of α2-6 sialylated glycans was confirmed by pretreatment of samples using Sialidase A and S. Isolated glycans were subsequently incubated with 0.1 U of *Arthrobacter ureafaciens* sialidase (Sialidase A, non-specific) or *Streptococcus pneumoniae* sialidase (Sialidase S, specific for α2-3 sialylated glycans) in a final volume of 100 mL of 50 mM sodium phosphate, pH 6.0 at 37° C. for 24 hrs. Neutral and the acidic fractions were analyzed by MALDI-TOF MS in positive and negative modes respectively.

Example 4: Binding of H5 HA Polypeptide Variants to Human Lung Tissues

Binding of Formalin fixed and paraffin embedded human tissue lung and tracheal sections are provided (e.g., purchased from US Biomax, Inc. and from US Biological, respectively). Tissue sections are deparaffinized, rehydrated and incubated with 1% BSA in PBS for 30 minutes to prevent non-specific binding. H5 HAs are pre-complexed with primary antibody (mouse anti 6xHis tag (SEQ ID NO: 207)) and secondary antibody (Alexa-fluor 488 goat anti mouse) in a ratio of 4:2:1, respectively, for 20 minutes on ice. The complexes formed are diluted in 1% BSA-PBS to a final HA concentration of 40, 20 or 10 µg/ml. Tissue sections are then incubated with the HA-antibody complexes for 3 hours at RT. Sections are counterstained with propidium iodide (Invitrogen; 1:100 in TBST), washed extensively and then viewed under a confocal microscope (Zeiss LSM510 laser scanning confocal microscopy).

Precomplexed H5 HAs are also used along with other lectins such as Jacalin (marker for non-ciliated mucinous cells such as goblet cells) to co-stain tissue sections to obtain additional information on whether HA stains ciliated and/or non-ciliated cells in the tissue epithelia.

Example 5: Testing H5 HA Polypeptide in an Animal Host

As described herein, the present invention encompasses the recognition that the use of animal hosts (e.g., ferrets) for the study of transmission of virus may provide a reliable indicator of human virus transmission. Similarly, the present invention encompasses the recognition that the use of animal hosts (e.g., ferrets) treated with binding agents in accordance with the invention (e.g., HA polypeptides) for the study of transmission of virus may provide a reliable indicator of the efficacy of such binding agents in accordance with the invention for prevention or treatment of virus in a human host.

Virus Transmission Assay

A virus transmission assay is used in the presence or absence of binding agents in accordance with the invention to determine viral transmission in a suitable animal model. For example, animal hosts, e.g., ferrets, are housed in adjacent cages that prevent direct and indirect contact between animals. However, these housing conditions allow the spread of influenza virus through the air. A first portion of the animals are innoculated via methods known in the art (e.g., intranasally, intramuscularly, or any of the modes of administration described herein) with an effective amount of virus ("innoculated animals"). Naïve animals can then be introduced into cages adjacent to the innoculated animals one, two, three or more days later.

Animals used in the study can be killed at any time one, two, three or more days post-inoculation or transmission for analysis. Suitable analysis for virus transmission studies can include, but is not limited to determination of infectious virus titers (e.g., by nasal washes), observation of physical symptoms in the animals (e.g., lethargy, anorexia, rhinorrhea, sneezing, high fever, and/or death), immunohistochemical analysis of respiratory tissues, among others.

The virus transmission assay described above can also incorporate the treatment of the animal host with a binding agent in accordance with the invention described herein before, during or after inoculation or transmission of virus. Analytic methods described herein are then used to determine the efficacy of the binding agent(s) in blocking transmission and/or infection of the animal host with the virus.

Serological Studies

Binding agents and/or vaccine compositions comprising binding agents are administered intramuscularly in ferrets on day 0, followed by a booster dose on day 21. Blood from each animal is recovered on days 0, 14, 21, and 35. The collected serum is examined in vitro for its ability to inhibit virus agglutination and neutralize virus infection.

Hemagglutination Inhibition (HAI) Assay

HAI titrations are performed in 96-well v-bottom plates (Corning). Sera are serially diluted 2-fold and added to 4 agglutinating doses of influenza A virus in a total volume of 200 µl. Next, 25 µl of a 2% (vol/vol) erythrocyte solution is added. Sera, virus, and erythrocytes are gently mixed and the assay is read out after incubating for 30 min. Titers are recorded as the inverse of the highest antibody dilution that inhibited 4 agglutinating doses of virus.

In Vitro Neutralization Assay

Serial dilutions of sera is mixed with viruses and incubated at room temperature for 30 min, and then incubated with MDCK cells for 1 hr at 37° C. Cells are then washed twice with serum-free media, and then fresh media with or without trypsin is added. Virus growth is scored by cytopathic effect. Data are expressed as the inverse dilution of highest dilution of sera that causes neutralization.

Virus Challenge Assay

Vaccinated ferrets are challenged intranasally with homologous and heterologous wild-type and mutant H5N1 strains. Nasal washes are taken from ferrets on days 1, 3, and 5 post-challenge. Virus is titrated in MDCK cells to determine virus shedding in the respiratory tract.

Example 5: A Two-Amino Acid Change in Recent Isolates of H5N1 Hemagglutinin is Sufficient to Switch its Preference to Human Receptors Introduction Highly pathogenic H5N1 is a global concern that has initiated several localized outbreaks in humans since 2003 (Heumann et al., 2010, *Cell Res*, 20:51; Guan et. al., 2009, *Rev Sci Tech*, 28:39; both of which are hereby incorporated by reference). Existing H5N1 strains are incapable of aerosol transmission but rather are primarily transmitted through direct contact with infected animals. However, the high morbidity and mortality rate associated with infection (~60%) as well as the known ability of influenza subtypes (including H5N1) to acquire phenotypic traits through either mutation or gene reassortment, suggests that a H5N1 strain could acquire aerosol transmissibility (Yen et. al., 2009, *Curr Top Microbiol Immunol*, 333:3; incorporated herein by reference). Coupled with the potential for such a virus to cause severe infection, the fact that the human population has no pre-existing immunity to H5N1, suggests that a future epidemic or pandemic may occur should such a strain arise (Subbarao et. al., 2007, *PLoS pathogens*, 3:e40; incorporated herein by reference).

The use of reverse genetics systems has indicated that of the 11 gene products, acquisition of certain amino acid changes in hemagglutinin (HA) and the polymerase (PB2) are vital for human aerosol transmission (Hoeven et. al., 2009, *Pro Natl Acad Sci USA*, 106:3366; incorporated herein by reference). Addressing the functional effect of genetic alterations in these proteins is thus especially important to identify the potential for phenotypic alterations. In the case of PB2, a critical alteration of lysine to glutamate at position 627 is key for acquiring aerosol transmissibility (Hoeven et. al., 2009, *Pro Natl Acad Sci USA*, 106:3366; incorporated herein by reference). However, given the biological role of HA, viz., binding to glycan receptors leading to fusion of the virion and infection, specific mutations that lead to human adaptation are thought to be subtype- and strain-specific (Stevens et. al., 2006, *Nat Rev Microbiol*, 4:857; Russell et. al., 2006, *Glycoconj J*, 23:85; both of which are hereby incorporated by reference).

Figure 20:
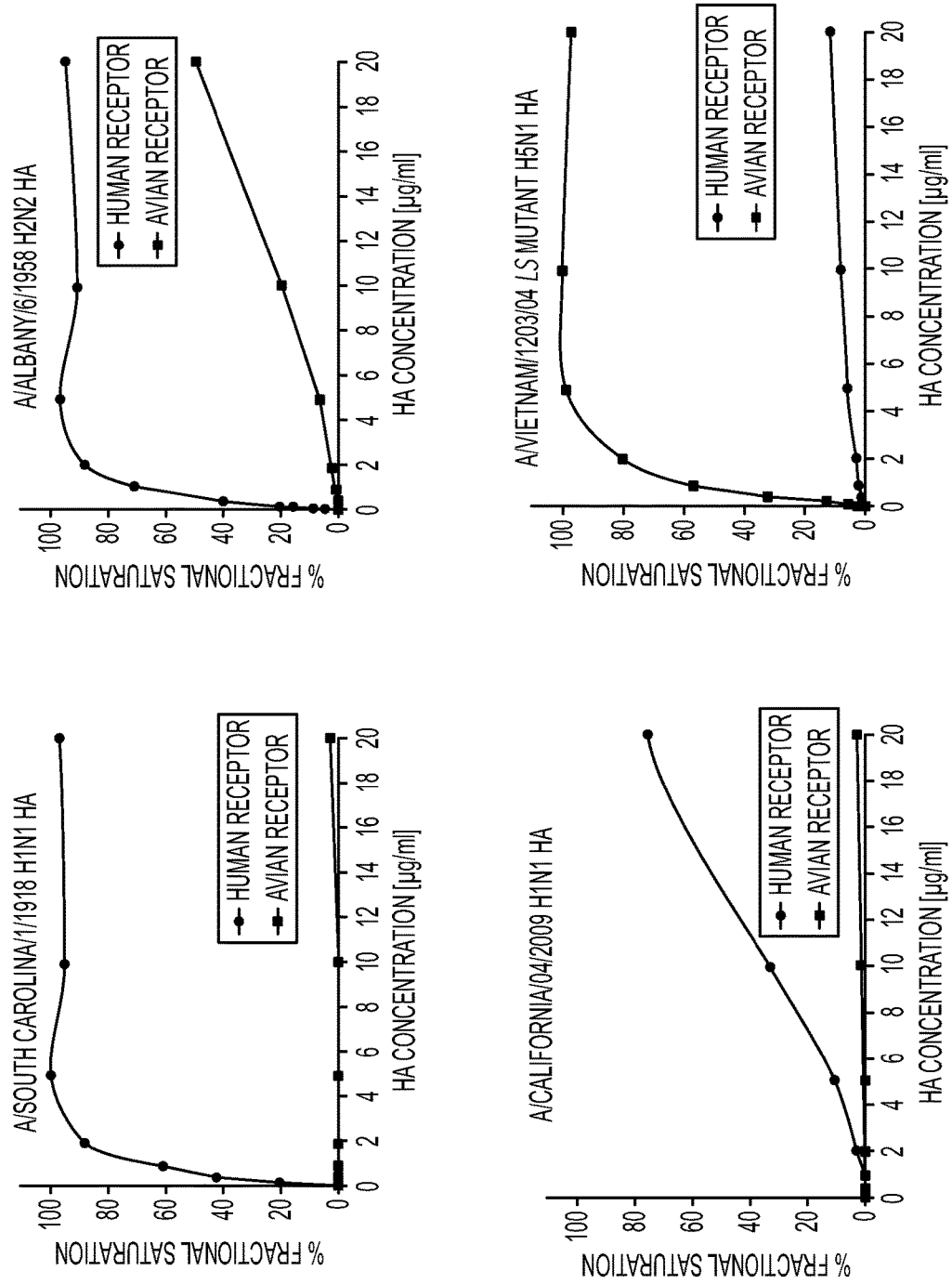
FIG. 20: Characteristic glycan-receptor binding properties of pandemic HAs The HAs from prototypic human-adapted pandemic 1918 H1N1 (S1) and 1958 H2N2 (S2) and 2009 H1N1 (S3) strains show specific high affinity binding to human receptors (6'SLN-LN) with minimal to substantially lower affinity binding (relative to human receptor affinity) to avian receptors (3'SLN-LN). On the other hand introducing the hallmark LS mutation in Viet1203_04 H5N1 HA sequence does not switch its receptor preference to the human receptor binding seen with the pandemic HAs.

Previous studies have identified that the receptor for HA are glycans terminated by particular glycan structures (e.g., "umbrella topology" or "cone topology" $\alpha 2 \rightarrow 3$ or $\alpha 2 \rightarrow 6$-linked sialic acid). Avian-adapted H5N1 HAs preferentially bind to glycan receptors terminated by cone topology glycans, many of which have $\alpha 2 \rightarrow 3$ linked sialic acid (avian receptors) (Stevens et al., 2006, *J Mol Biol*, 355:1143; Gambaryan et. al., 2006, *Virology*, 344:432; both of which are hereby incorporated by reference). HAs of human-adapted H1N1, H2N2, and H3N2 strains have a demonstrated switch in binding preference from cone topology (e.g., many $\alpha 2 \rightarrow 3$) to umbrella topology (e.g., many $\alpha 2 \rightarrow 6$ sialylated glycans) (human receptors) and a characteristic high affinity binding to human receptors, which have been shown to correlate with the airborne transmissibility of these human-adapted viruses (Pappas et. al., 2010, *PLoS One*, 5:e11158; Tumpey et. al., 2007, *Science*, 315:655; both of which are hereby incorporated by reference). Utilizing this framework, recent studies have identified sets of mutations which would lead to human adaptation of the currently circulating strains of H2N2, H7N7 and H9N2 (Viswanathan et. al., 2010, *PLoS One*, 5:e13768; Belser et. al., 2008, *Proc Natl Acad Sci USA*, 105:7558; Sorrell et. al., 2009, *Proc Natl Acad Sci USA*, 106:7565; all of which are hereby incorporated by reference). These studies demonstrate that mutations required for conversion may differ based on the subtype, and even the particular strain, studied. Previous studies (Maines et. al., 2011, *Virology*, 413:139; Stevens et. al., 2008, *J Mol Biol*, 381:1382; Stevens et. al., 2006, *Science*, 312:404; all of which are hereby incorporated by reference) that have mutated H5N1 strains to include either the hallmark changes for H2/H3 (Q226L and G228S or LS) and/or H1 (E190D, G225D or DD) mutations have shown that none of these mutants quantitatively 'switch' to human receptor specificity and affinity which is characteristic of human-adapted 'pandemic' strain HAs (FIG. 20). Attempts to introduce the hallmark LS residues on the A/Vietnam/1203/04 (Viet03_04) sequence have not yielded the switch. The present inventors have established key structural features that are needed to suitably accommodate the hallmark LS residues. The present inventors have also determined which structural features are required to facilitate a switch in receptor specificity as enable binding with high affinity to human receptors.

Experimental Design

Influenza HA is a homotrimeric protein, wherein a monomer contains 552 amino acids. Each monomer is composed of two disulphide-linked moieties, HA1 and HA2. HA1 comprises the glycan-receptor binding site (RBS), whereas HA2 is involved in the fusion of the viral and cellular membranes. The RBS pocket involves HA positions 95, 131, 133, 136, 137, 138, 145, 153, 155, 156, 158, 159, 183, 186, 187, 189, 190, 192, 193, 194, 195, 196, 219, 222, 224, 225, 226, 227, 228 (H3 numbering used).

Figure 21:
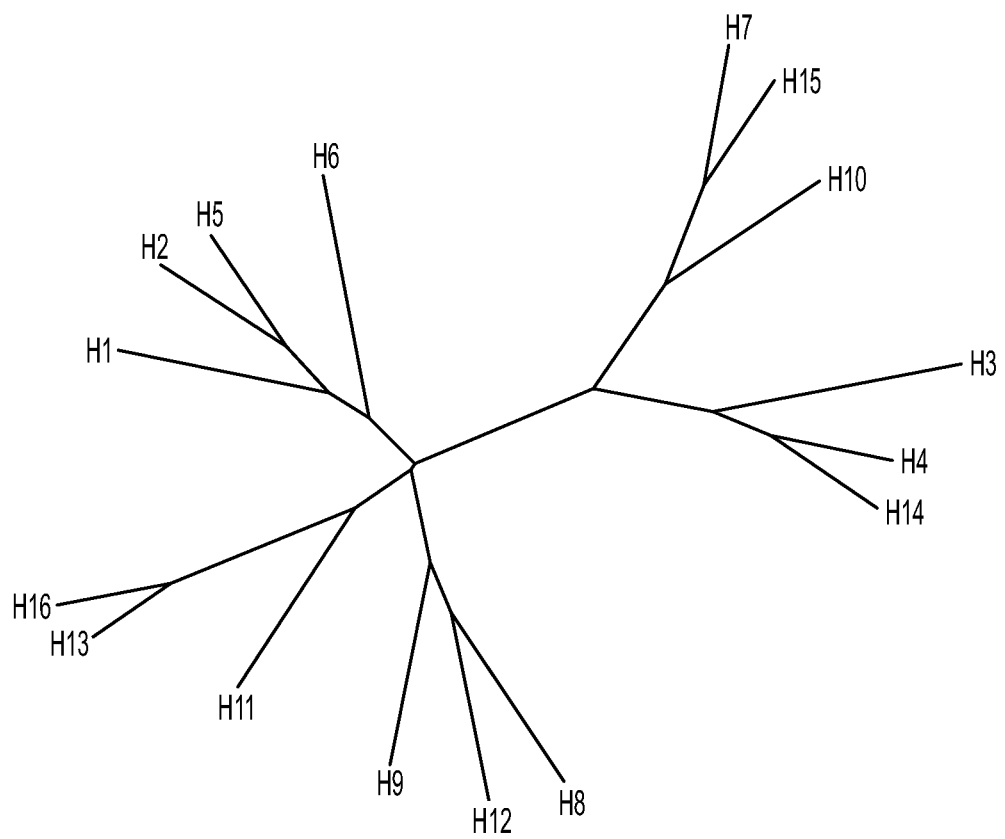
FIG. 21: Phylogeny tree of representative sequences from HA subtypes Branches leading to clade 1 & 2 HAs are labeled and colored in red and blue, respectively. Closely related subtypes are located on branches close to one another.
Figure 22:
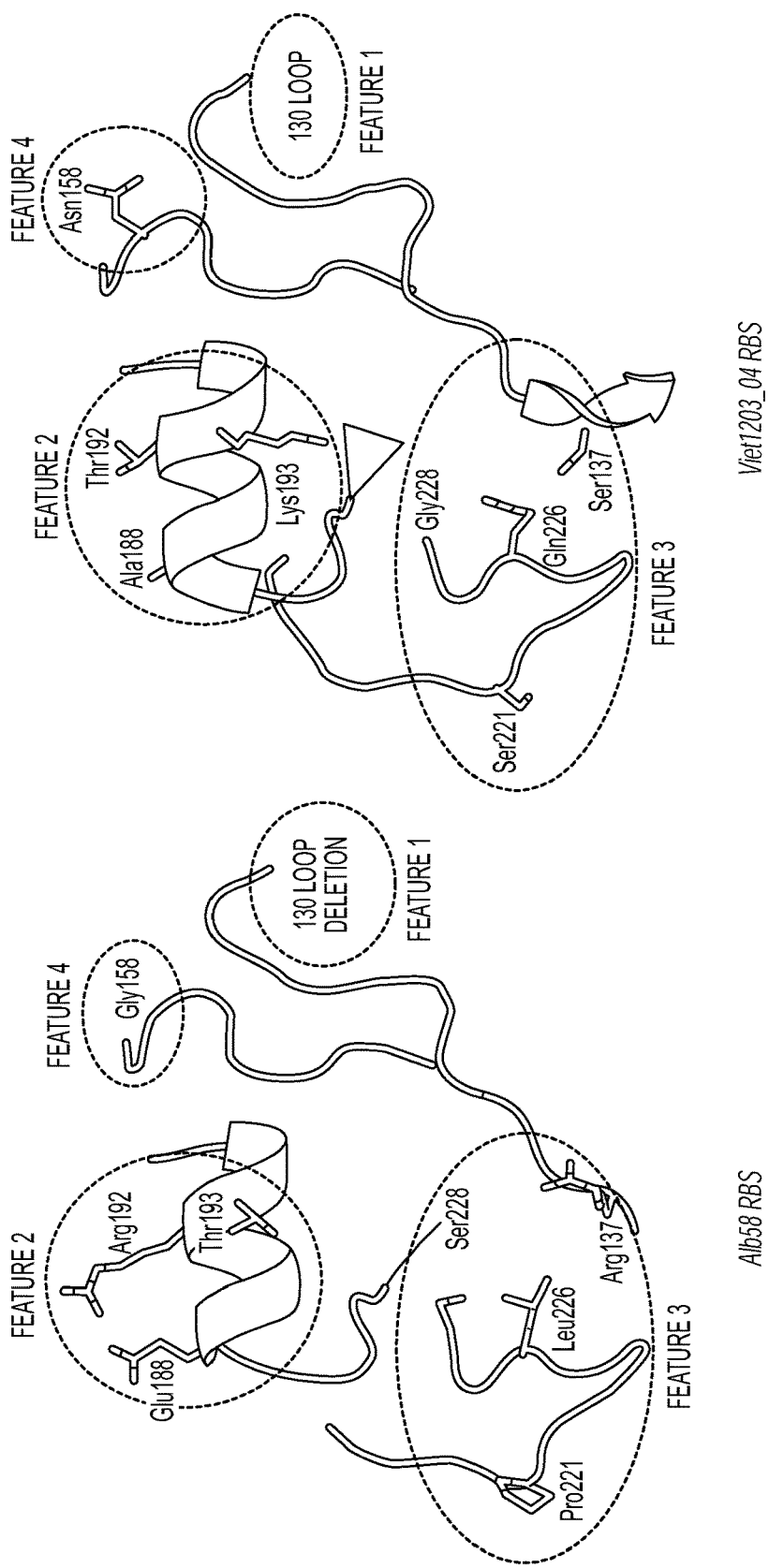
FIG. 22: Key structural features within the RBS of H5 HA Shown in the figure is the cartoon rendering of RBS of Alb6_58 HA (gray) and Viet0304 (green) with side chains of amino acids that are different between these HAs. The four features that distinguish the H2 and H5 RBS as described in the text are highlighted in dotted red circles.

In order to determine structural features and correct H5 HA sequences that will accommodate the LS residues, the current inventors performed a detailed structural comparison of the RBS H2 and H5 HA, since H5 HA is closest to H2 HA phylogenitically (FIG. 21). For this study, the prototypic pandemic H2 (A/Albany/6/58 or Alb6_58) HA with the representative H5N1 HA from an earlier human isolate (A/Vietnam/1203/04 or Viet03_04) was chosen. Having made a comparative analysis, the current study identified four distinct features which distinguish the RBS of H5 HA from that of H2 HA (FIG. 22). First, the composition of the 130 loop of H2 HA is different from H5 HA, which includes a deletion at position 130 (H3 numbering) in H5 HA. Second, there are differences in amino acid composition at the 'top' of the RBS or the '190-helix' (such as in positions 188, 192 and 193) that interact with sugar residues beyond the terminal Neu5Ac$\alpha$2-6Gal- motif of the human receptor. Third, there are differences in amino acid compositions at the 'base' of the RBS (such as in positions 137, 221, 226 and 228 which include LS changes) that interact with the Neu5Ac$\alpha$2-6Gal- motif of the human receptor. Fourth, the glycosylation site at position 158 in H5 HA is absent in H2 HA. Glycosylation at this site could potentially interfere with sugar residues beyond the terminal Neu5Ac$\alpha$2-6Gal-motif of the human receptor bound to the RBS (Stevens et. al., 2008, *J Mol Biol*, 381:1382; Wang et. al., 2010, Journal of Virology, 84:6570; both of which are hereby incorporated by reference). The inventive findings encompass this detailed comparison of RBS of H2 and H5 HA, which suggests particular amino acid differences that go beyond the more characteristic LS changes previously observed. The present inventors sought to identify appropriate H5 HA sequences that would facilitate matching the structural features of H2 HA RBS in the context of the LS mutations.

Analysis of all the H5N1 sequences to-date (both avian and human isolates) allowed the inventors to make three further observations: 1) H5 HAs from many of the recent avian and human isolates (after 2007) have already acquired the deletion in the 130-loop matching the first feature, 2) key amino acid changes were already observed in the '190-helix' matching feature 2, and 3) loss of glycosylation at 158 position (feature 4) is also observed in many H5 HA sequences. In the context of the key structural features of HA RBS, the inventors determined that the deletion in the 130 loop along with a loss of glycosylation (features 1 and 4) concurrently in the same HA was critical in the evolution of H5 HA. The present invention, however, encompasses the recognition that the loss of glycosylation is concomitant with the deletion of 130-loop residue and not vice versa. The present invention encompasses the observation that specific current H5 HA strains have diverged considerably from older human isolates (such as Viet03_04), but have also acquired key structural features necessary for matching the pandemic H2 HA RBS.

Thus the present inventors assessed whether strains that have features 1 and 4 would be the correct H5 HA sequence to suitably accommodate the hallmark LS residues. For the experiment strain A/chicken/Egypt/R2/2007 (or ckEgy_07) was chosen as a representative H5 HA which naturally acquired features 1 and 4 (FIG. 23). Introduction of just the LS mutation (ckEgy_07_LS) on this H5 HA sequence showed a switch and high affinity binding to human receptors (and relatively poor affinity to avian receptors), thereby resembling the glycan binding characteristics of human-adapted 'pandemic' HAs (FIG. 24 A,B and FIG. 25). Additional findings demonstrate binding of this mutant H5 HA to human receptors on the apical surface of the human tracheal epithelia (FIG. 24C) that resembles the staining of this tissue by pandemic HAs (Viswanathan et. al., 2010, *PLoS One*, 5:e13768; Maines et. al., 2009, *Science*, 325:484; both of which are hereby incorporated by reference).

Earlier efforts by others to introduce the LS changes alone on older human isolates such as Viet03_04 did not lead to a switch and underscored the need to understand structural features of H5 HA RBS that can accommodate the LS mutations. Given that the (ckEgy_07_LS) also naturally acquired feature 4, the inventors assessed whether this feature alone i.e. loss of glycosylation (achieved through T160A mutation) together with LS switches the glycan receptor-binding preference of Viet03_04 (FIG. 25). Compared to Viet03_04 wild-type HA, the dose-dependent direct glycan binding of this mutant strain showed human receptor-binding but also retained its high affinity avian receptor binding which is uncharacteristic of pandemic human-adapted HAs (FIG. 25). Introduction of the LS change alone on another strain (A/Egypt/2786-NAMRU3/06 or Egy_06), which naturally acquired feature 4, corroborates this observation. Finally, consistent with this structural framework, mutations on a representative H5 HA (A/chicken/Vietnam/NCVD-093/08 or ckViet_08), which naturally acquired feature 2 (FIG. 22C) conferred human receptor binding affinity but also retained high affinity avian receptor binding (FIG. 26).

Discussion

Figure 27A:
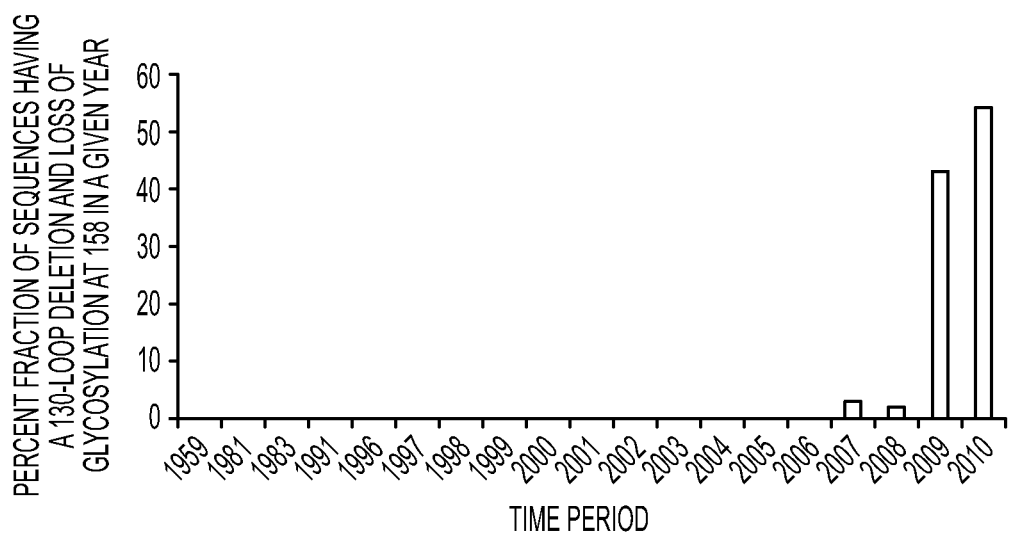
FIG. 27: Emergence of key features in recent avian H5 and human H5N1 isolates A, Percentage of avian and human H5N1 isolates whose HA has acquired amino acid changes to match features 1 and 4 of H2 HA RBS is plotted as function of year when the strain was isolated. There has been a dramatic increase in percentage of isolates having these key features since their initial emergence in 2007. Phylogenetic analysis of the sequences of these isolates showed that they belonged to clade 2.2.1. B, Percentage of avian and human isolates whose HA has acquired amino acid changes to match feature 2 of H2 HA RBS. Only a small percentage of H5N1 isolates have acquired this feature. Full-length non-redundant HA sequences from NCBI Influenza Virus Resource were aligned, and number of occurrences of each of the features was calculated in a given year and expressed as percentage. A total of 2277 full-length non-redundant H5N1 sequences were employed for the analysis.
Figure 27B:
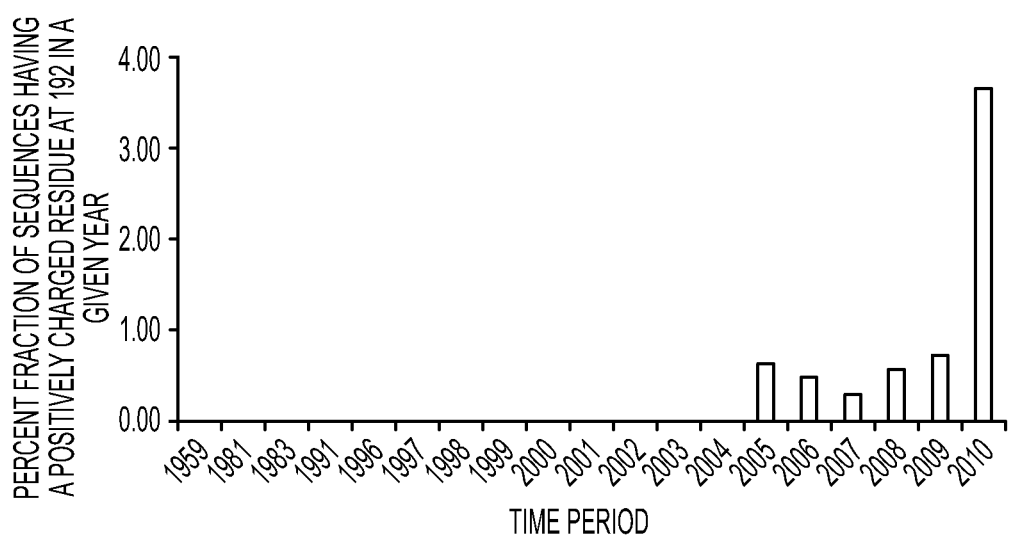

The present inventors, for the first time, have defined certain structural features that are needed to suitably accommodate the hallmark LS residues. In addition, the inventors results provide the insight that certain current circulating H5 HAs only require two amino acid changes, the hallmark LS, to switch H5 HA preference to human receptors thereby leading to their human adaptation. Using the information from the invention, the inventors rationally selected appropriate H5 HA sequences (albeit from a small representative pool of total H5N1 HAs) that was amenable to switching receptor specificity by incorporating just the LS changes. One characteristic property of these current H5 HAs is that they have naturally evolved to acquire features 1, 2 and 4 (FIG. 27). Although, only 6% of the 2277 non-redundant H5N1 HA sequences in the NCBI database have acquired features 1 & 4, however, it represents about 45% of H5N1 strains isolated in 2009 and 2010. Further phylogenetic analyses of the H5N1 HAs reveal that the naturally acquired features 1 & 4 belong to clade 2.2.1. Thus far, occurrence of feature 1 appears to be exclusive to clade 2.2.1, however the existence of feature 4 is not restricted to 2.2.1. Critically, the clade 2.2.1 strains have already diverged considerably from older human isolates (such as Viet03_04) and are closer to human adaptation than these previous strains. All of the reported human H5N1 isolates belonging to clade 2.2.1 are from Egypt and Israel. Therefore, it is important to monitor the evolution of the clade 2.2.1 strains.

Exemplary H5N1 Strains with a Positively Charged Residue at Position 129 (Feature 2)

ABJ96761/204-204 Avian China 2005 from clade 2.3.4;
ABJ96763/204-204 Avian China 2005 from clade 2.3.4;
ABJ96764/204-204 Avian China 2006 from clade 2.3.4;
ACN39415/204-204 Avian China 2007 from clade 2.3.4;
ACO07037/204-204 Avian Viet Nam 2008 from clade 7;
ADG28677/204-204 Avian Egypt 2009 from clade 2.2.1;
ADI58758/204-204 Avian Israel 2010 from clade 2.2.1;
ADM85869/204-204 Avian Egypt 2010 from clade 2.2.1;
and ADG28684/204-204 Avian Egypt 2010 from clade 2.2.1.

Exemplary H5N1 Strains with a Deletion at 130 (and Loss of Glycosylation at 158) on the Same HA all Belonging to Clade 2.2.1(Feature 1). Include but are not Limited to:

```
ABP96845 Human Egypt 2007
                                                      (SEQ ID NO. 122)
MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKRDNAYPTIKRSYNNTNQEDLLVLWGIHHPNDAAEQXRLYQNPTTY

ISVGTSTLNQRLVPKIATRSKVNGQXGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKLESIGTYQILSIYSTVASSLALAIMVAGLSLWMCSNGSLQCRICI

>ABP96854 Human Egypt 2007
                                                      (SEQ ID NO. 123)
MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKDNAYPTIKRSYNNTNQEDLLVLWGIHHPNDAAEQTRLYQNPTTY

ISVGTSTLNQRLVPKIATRSKVNGQSGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKLESIGTYQILSIYSTVASSLALAIMVAGLFLWMCSNGSLQCRICI
```

>ABM92273 Egypt 2007

(SEQ ID NO. 124)

MEKIVLLLAIVSLVKSDQICIGYHANNSTEQVDTIMEKNVTVTHAQDILEKTHNGKLCNLNGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKDNAYPTIKRSYNNTNQEDLLVLWGIHHPNDAAEQTRLYQNPTTY

ISVGTSTLNQRLVPKIAARSKVNGQSGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKLESIGTYQILSIYSTVASSLALAIMVAGLFLWMCSNGSLQCRICI

>ACT15310 Human Egypt 2009

(SEQ ID NO. 125)

MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRPSFFRNVVWLTKKDNAYPTIKRSYNNTNQEDLLVLWGIHHPXDAAEQTRLYQNPTTY

ISVGTSTLNQRLVPKIATRSKVNGQSGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIGNL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKMESIGTYQILSIYSTVASSLALAIMVAGLFLWMCSNGSLQCRICI

>ACT15312 Human Egypt 2009

(SEQ ID NO. 126)

MEKIVLLLAIVSIVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKNNAYPTIKRSYNNTNQEDLLVLWGIHHPNDAAEQTRLYQNPTTY

ISVGTSTLNQRLVPKIATRSKVNGQSGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKLESIGTYQILSIYSTVASSLALAIMVAGLFLWMCSNGSLQCRICI

>ACT15314 Human Egypt 2009

(SEQ ID NO. 127)

MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKNNAYPTIKRSYNNTNQEDLLVLWGIHHPNDAAEQTRLYQNPTTY

ISVGTSTLNQRLVPKITTRSKVNGQSGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKLESIGTYQILSIYSTVASSLALAIMVAGLFLWMCSNGSLQCRICI

>ACT15316 Human Egypt 2009

(SEQ ID NO. 128)

MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKDNAYPTIKRSYNNTNQEDLLVLWGIHHPNDAAEQTRLYQNPTTY

ISVGTSTLNQRLIPKIATRSKVNGQSGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG
FIEGGWQGMVDGWYGYHHSNEQGSYAADKESTQKAIDGVTNKVNSIIDKMNTQFEAVGREFNNLERRIENL
NKKMEDGFLDVWTYNAELLVLMENERTLDFHDSNVKNLYDKVRLQLRDNAKELGNGCFEFYHRCDNECMESV
RNGTYDYPQYSEEARLKREEISGVKLESIGTYQILSIYSTVASSLALAIMVAGLFLWMCSNGSLQCRICI

>ACT15318 Human Egypt 2009
(SEQ ID NO. 129)
MEKIVLLLAIVSLVKSDQICIGYHANNSTEQVDTIMEKNVTVTHAQDILEKTHNGKLCNLDGVKPLILR
DCSVAGWLLGNPMCDEFLNVPEWSYIVEKINPANDLCYPGNFNDYEELKHLLSRINHFEKIQIIPKNSWSDH
EASGVSSACPYQGRSSFFRNVVWLTKKDNAYPTIKRSYNNTNQEDLLVLWGIHHPNDAAEQTRLYQNPTTY
ISVGTSTLNQRLVPKIATRSKVNGQSGRMEFFWTILKSNDAINFESNGNFIAPENAYKIVKKGDSTIMKSEL
EYGNCNTKCQTPIGAINSSMPFHNIHPLTIGECPKYVKSNRLVLATGLRNSPQGERRRKKRGLFGAIAG
FIEGGWQGMVDGWYGYHHSNEQGSYAADKESTQKAIDGVTNKVNSIIDKMNTQFEAVGREFNNLERRIENL
NKKMEDGFLDVWTYNAELLVLMENERTLDFHDSNVKNLYDKVRLQLRDNAKELGNGCFEFYHRCDNECMESV
RNGTYDYPQYSEEARLKREEISGVKLESIGTYQILSIYSTVASSLALAIMVAGLFLWMCSNGSLQCRICI >ACT15320 Human Egypt 2009
(SEQ ID NO. 130)
MEKIVLLLAIVSLVKSDQICIGYHANNSTEQVDTIMEKNVTVTHAQDILEKTHNGKLCNLDGVKPLILR
DCSVAGWLLGNPMCDEFLNVPEWSYIVEKINPANDLCYPGNFNDYEELKHLLSRINHFEKIQIIPKNSWSDH
EASGMSSACPYQGRSSFFRNVVWLTKKDNAYPTIKRSYNNTNQEDLLVLWGIHHPNDAAEQTRLYQNPTTY
ISVGTSTLNQRLVPKIATRSKVNGQSGRMEFFWTILKSNDAINFESNGNFIAPENAYKIVKKGDSTIMKSEL
EYGNCNTKCQTPIGAINSSMPFHNIHPLTIGECPKYVKSNRLVLATGLRNSPQGERRRKKRGLFGAIAG
FIEGGWQGMVDGWYGYHHSNEQGSYAADKESTQKAIDGVTNKVNSIIDKMNTQFEAVGREFNNLERRIENL
NKKMEDGFLDVWTYNAELLVLMENERTLDFHDSNVKNLYDKVRLQLRDNAKELGNGCFEFYHRCDNECMESV
RNGTYDYPQYSEEARLKREEISGVKLESIGTYQILSIYSTVASSLALAIMVAGLFLWMCSNGSLQCRICI >ACT15322 Human Egypt 2009
(SEQ ID NO. 131)
MEKIVLLLAIVSLVKSDQICIGYHANNSTEQVDTIMEKNVTVTHAQDILEKTHNGKLCNLDGVKPLILR
DCSVAGWLLGNPMCDEFLNVPEWSYIVEKINPANDLCYPGNFNDYEELKHLLSRINHFEKIQIIPKNSWSDH
EASGVSSACPYQGRSSFFRNVVWLTKKDNAYPTIKRSYNNTNQEDLLVLWGIHHPNDAAEQTRLYQNPTTY
ISVGTSTLNQRLVPKIATRSKVNGQSGRMEFFWTILKSNDAINFESNGNFIAPENAYKIVKKGDSTIMKSEL
EYGNCNTKCQTPIGAINSSMPFHNIHPLTIGECPKYVKSNRLVLATGLRNSPQGERRRKKRGLFGAIAG
FIEGGWQGMVDGWYGYHHSNEQGSYAADKESTQKAIDGVTNKVNSIIDKMNTQFEAVGREFNNLESRIENL
NKKMEDGFLDVWTYNAELLVLMENERTLDFHDSNVKNLYDKVRLQLRDNAKELGNGCFEFYHRCDNECMESV
RNGTYDYPQYSEEARLKREEISGVKLESIGTYQILSIYSTVASSLALAIMVAGLFLWMCSNGSLQCRICI >ACT15324 Human Egypt 2009
(SEQ ID NO. 132)
MEKIVLLLAIVSLVKSDQICIGYHANNSTEQVDTIMEKNVTVTHAQDILEKTHNGKLCNLDGVKPLILR
DCSVAGWLLGNPMCDEFLNVPEWSYIVEKINPANDLCYPGNFNDYEELKHLLSRINHFEKIQIIPKNSWSDH
EASGVSSACPYQGRSSFFRNVVWLTKKNNAYPTIKRSYNNTNQEDLLVLWGIHHPNDAEEQTRLYQNPTTY
ISVGTSTLNQRLVPKIATRSKVNGQSGRMEFFWTILKSNDAINFESNGNFIAPENAYKIVKKGDSTIMKSEL
EYGNCNTKCQTPIGAINSSMPFHNIHPLTIGECPKYVKSNRLVLATGLRNSPQGERRRKKRGLFGAIAG
FIEGGWQGMVDGWYGYHHSNEQGSYAADKESTQKAIDGVTNKVNSIIDKMNTQFEAVGREFNALERRIENL
NKKMEDGFLDVWTYNAELLVLMENERTLDFHDSNVKNLYDKVRLQLRDNAKELGNGCFEFYHRCDNECMESV
RNGTYDYPQYSEEARLKREEISGVKLESIGTYQILSIYSTVASSLALAIMVAGLFLWMCSNGSLQCRICI -continued >ACT15326 Human Egypt 2009
(SEQ ID NO. 133)
MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKDNAYPTIKRSYNNTNQEDLLVLWGIHHPNDAAEQTRLYQNPTTY

ISVGTSTLNQRLIPKIATRSKVNGQSGRMEFFWTILKPNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKLESIGTYQILSIYSTVASSLALAIMVAGLFLWMCSNGSLQCRICI

>ACT15328 Human Egypt 2009
(SEQ ID NO. 134)
MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKDNAYPTIKRSYNNTNQEDLLVLWGIHHPNDAAEQTRLYQNPTTY

ISVGTSTLNQRLVPKIATRSKVNGQNGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPHYSEEARLKREEISGVKLESIGTYQILSIYSTVASSLALAIMVAGLFLWMCSNGSLQCRICI

>ACT15330 Human Egypt 2009
(SEQ ID NO. 135)
MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKDNAYPTIKRSYNNTNQEDLLVLWGIHHPNDAAEQTRLYQNPTTY

ISVGTSTLNQRLVPKIATRSKVNGQSGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPHYSEEARLKREEISGVKLESIGTYQILSIYSTVASSLALAIMVAGLFLWMCSNGSLQCRICI

>ACT15334 Human Egypt 2009
(SEQ ID NO. 136)
MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKDNAYPTIKRSYNNTNQEDLLVLWGIHHPNDAAEQTRLYQNPTTY

ISVGTSTLNQRLVPKIATRSKVNGQSGRMEFFWTILKSNDAINFESNGNFIAPENAYKIVKKGDSTIMKSEL

EYGNCNTKCQTPIGAINSSMPFHNIHPLTIGECPKXVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKLESIGTYQILSIYSTVASSLALAIMMAGLFLWMCSNGSLQCRICI

>ACT15336 Human Egypt 2009
(SEQ ID NO. 137)
MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKDNAYPTIKRSYNNTNQEDLLVLWGIHHPNDAAEQTRLYQNPTTY

ISVGTSTLNQRLVPKIATRSKVNGQSGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG
FIEGGWQGMVDGWYGYHHSNEQGSGYAADKESTQKAIDGVTNKVNSIIDKMNTQFEAVGREFNNLERRIENL
NKKMEDGFLDVWTYNAELLVLMENERTLDFHDSNVKNLYDKVRLQLRDNAKELGNGCFEFYHRCDNECMESV
RNGTYDYPQYSEEARLKREEISGVKLESIGTYQILSIYSTVASSLALAIMVAGLFLWMCSNGSLQCRICI

>ACT15338 Human Egypt 2009
(SEQ ID NO. 138)
MEKIVLLLAIVSLVKSDQICIGYHANNSTEQVDTIMEKNVTVTHAQDILEKTHNGKLCNLDGVKPLILR
DCSVAGWLLGNPMCDEFLNVPEWSYIVEKINPANDLCYPGNFNDYEELKHLLSRINHFEKIQIIPKNSWSDH
EASGVSSACPYQGRSSFFRNVVWLTKKNNAYPTIKRSYNNTNQEDLLVLWGIHHPNDATEQTRLYQNPTTY
ISVGTSTLNQRLIPKIATRSKVNGQSGRMEFFWTILKSNDAINFESNGNFIAPENAYKIVKKGDSTIMKSEL
EYGNCNTKCQTPIGAINSSMPFHNIHPLTIGECPKYVKSNRLVLATGLRNSPQEGRRRKKRGLFGAIAG
FIEGGWQGMVDGWYGYHHSNEQGSGYAADKESTQKAIDGVTNKVNSIIDKMNTQFEAVGREFNNLERRIENL
NKKMEDGFLDVWTYNAELLVLMENERTLDFHDSNVKNLYDKVRLQLRDNAKELGNGCFEFYHRCDNECMESV
RNGTYDYPQYSEEARLKREEISGVKLESIGTYQILSIYSTVASSLALAIMVAGLFLWMCSNGSLQCRICI >ACT15340 Human Egypt 2009
(SEQ ID NO. 139)
MEKIVLLLAIVSLVKSDQICIGYHANNSTEQVDTIMEKNVTVTHAQDILEKTHNGKLCNLDGVKPLILR
DCSVAGWLLGNPMCDEFLNVPEWSYIVEKINPANDLCYPGNFNDYEELKHLLSRINHFEKIQIIPKNSWSDH
EASGVSSACPYQGRSSFFRNVVWLTKKNNAYPTIKRSYNNTNQEDLLVLWGIHHPNDAEEQTRLYQNPTTY
ISVGTSTLNQRLVPKIATRSKVNGQSGRMEFFWTILKSNDAINFESNGNFIAPENAYKIVKKGDSTIMKSEL
EYGNCNTKCQTPIGAINSSMPFHNIHPLTIGECPKYVKSNRLVLATGLRNSPQGERRRKKRGLFGAIAG
FIEGGWQGMVDGWYGYHHSNEQGSGYAADKESTQKAIDGVTNKVNSIIDKMNTQFEAVGREFNALERRIENL
NKKMEDGFLDVWTYNAELLVLMENERTLDFHDSNVKNLYDKVRLQLRDNAKELGNGCFEFYHRCDNECMESV
RNGTYDYPQYSEEARLKREEISGVKLESIGTYQILSIYSTVASSLALAIMVAGLFLWMCSNGSLQCRICI >ACT15342 Human Egypt 2009
(SEQ ID NO. 140)
MEKIVLLLAIVSLVKSDQICIGYHANNSTEQVDTIMEKNVTVTHAQDILEKTHNGKLCNLDGVKPLILR
DCSVAGWLLGNPMCDEFLNVPEWSYIVEKINPANDLCYPGSFNDYEELKHLLSRINHFEKIQIIPKNSWSDH
EASGVSSACPYQGRSSFFRNVVWLTKKDNAYPTIKRSYNNTNQEDLLVLWGIHHPNDAAEQTRLYQNPTTY
ISVGTSTLNQRLVPKIATRSKVNGQSGRMEFFWTILKPNDAINFESNGNFIAPENAYKIVKKGDSTIMKSEL
EYGNCNTKCQTPIGAINSSMPFHNIHPLTIGECPKYVKSNRLILATGLRNSPQGERRRKKRGLFGAIAG
FIEGGWQGMVDGWYGYHHSNEQGSGYAADKESTQKAIDGVTNKVNSIIDKMNTQFEAVGREFNNLERRIENL
NKKMEDGFLDVWTYNAELLVLMENERTLDFHDSNVKNLYDKVRLQLRDNAKELGNGCFEFYHRCDNECMESV
RNGTYDYPQYSEEARLKREEISGVKLESIGTYQILSIYSTVASSLALAIMVAGLFLWMCSNGSLQCRICI >ACT15343 Human Egypt 2009
(SEQ ID NO. 141)
MEKIVLLLAIVSLVKSDQICIGYHANNSTEQVDTIMEKNVTVTHAQDILEKTHNGKLCNLDGVKPLILR
DCSVAGWLLGNPMCDEFLNVPEWSYIVEKINPANDLCYPGNFNDYEELKHLLSRINHFEKIQIIPKNSWSDH
EASGVSSACPYQGRSSFFRNVVWLTKKDNAYPTIKRSYNNTNQEDLLVLWGIHHPNDAAEQTRLYQNPTTY
ISVGTSTLNQRLVPKIATRSKVNGQSGRMEFFWTILKSNDAINFESNGNFIAPENAYKIVKKGDSTIMKSEL
EYGNCNTKCQTPIGAINSSMPFHNIHPLTIGECPKYVKSNRLVLATGLRNSPQGERRRKKRGLFGAIAG
FIEGGWQGMVDGWYGYHHSNEQGSGYAADKESTQKAIDGVTNKVNSIIDKMNTQFEAVGREFNNLERRIENL
NKKMEDGFLDVWTYNAELLVLMENERTLDFHDSNVKNLYDKVRLQLRDNAKELGNGCFEFYHRCDNECMESV
RNGTYDYPQYSEEARLKREEISGVKLESIGTYQILSIYSTVASSLALAIMVAGLFLWMCSNGSLQCRICI -continued >ACT15345 Human Egypt 2009

(SEQ ID NO. 142)

MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSSCPYQGRSSFFRNVVWLTKKDNAYPTIKRSYNNTNQEDLLVLWGIHHPNDAAEQTRLYQNPTTY

ISVGTSTLNQRLVPKIATRSKVNGQSGRMEFFWTILKSNDAINFGSNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKLESIGTYQILSIYSTVASSLALAIMVAGLFLWMCSNGSLQCRICI

>ACT15349 Human Egypt 2009

(SEQ ID NO. 143)

MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKDNAYPTIKRSYNNTNQEDLLVLWGIHHPNDATEQTRLYQNPTTY

ISVGTSTLNQRLIPKIATRSKVNGQSGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQEERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKLESIGTYQILSIYSTVASSLALAIMVAGLFLWMCSNGSLQCRICI

>ACT15353 Human Egypt 2009

(SEQ ID NO. 144)

MEKIVLLLAIVSLVKSDQICIGYHANNSTEQVDTIMEKNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTKKNSAYPTIKRSYNNTNQEDLLVLWGIHHPNDAAEQTRLYQNPTTY

ISVGTSTLNQRLVPKIATRSKVNGQSGRMEFFWTILKSNDAINFESNGNFIAPENAYKIVKKGDSTIMKSEL

EYSNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKLESIGTYQILSIYSTVASSLALAIMVAGLFLWMCSNGSLQCRICI

>ACT15357 Human Egypt 2009

(SEQ ID NO. 145)

MEKIVLLLAIVSLVKSDQICIGYHANNSTEQVDTIMERNVTVTHAQDILEKTHNGKLCNLDGVKPLILR

DCSVAGWLLGNPMCDEFLNVPEWSYIVEKINPANDLCYPGNFNDYEELKHLLSRINHFEKIQIIPKNSWSDH

EASGVSSACPYQGRSSFFRNVVWLTQKDNAYPTIKRSYNNTNQEDLLVLWGIHHPNDAAEQTRLYQNPTTY

ISVGTSTLNQRLIPKIATRSKVNGQSGRMEFFWTILKSNDAINFESNGNFIAPENAYKIVKKGDSTIMKSEL

EYGNCNTKCQTPIGAINSSMPFHNIHPLTIGECPKYVKSNRLVLATGLRNSPQGERRRKKRGLFGAIAG

FIEGGWQGMVDGWYGYHHSNEQGSGYAADKESTQKAIDGVTNKVNSIIDKMNTQFEAVGREFNNLERRIENL

NKKMEDGFLDVWTYNAELLVLMENERTLDFHDSNVKNLYDKVRLQLRDNAKELGNGCFEFYHRCDNECMESV

RNGTYDYPQYSEEARLKREEISGVKLESIGTYQILSIYSTVASSLALAIMVAGLFLWMCSNGSLQCRICI

>ABY79033 Avian Egypt 2007

(SEQ ID NO. 146)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIKIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

-continued

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKKSTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEAKLKREEISGVKLESIGTYQILSIYSTVASSLALAIMVAGLFLWMCSNGSLQCRI

CI

>ABW37432 Avian Egypt 2007

(SEQ ID NO. 147)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

QISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKRRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ABW37433 Avian Egypt 2007

(SEQ ID NO. 148)

MEKIVLLLAIVSLVESDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ABW37434 Avian Egypt 2007

(SEQ ID NO. 149)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGKRRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ABW37435 Avian Egypt 2007

(SEQ ID NO. 150)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVVSSLALAIMVAGLFLWMCSNGSLQCRI

CI

>ABW37436 Avian Egypt 2007

(SEQ ID NO. 151)

MEKIVLLLAIVSVVKSDQICIGYHANYSTEQVDTIMEKDVIVTHAQDILEKTHNGKLCNLEGMKPLIL

RDCSVAGWLLGNPMCDEFHNVPEWSYIVEKINPANDLCYPGNFDDYEELQHLFSRINHFEKIQIIPKNCWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGKRRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKEFGNGCFEFYHRCDNEC

MESVRNGTYDYPQYSEEARLKREEISGVKLESIGTYQILSIYSTVASSLALAIMVAGLFLWMCSNGSLQCRI

CI

>ACR56233 Avian Egypt 2008

(SEQ ID NO. 152)

MEKIMLLLAIVSLVKGDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTKLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIVGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ACR56248/1552 Avian Egypt 2008

(SEQ ID NO. 153)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYSNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLF

>ACR56246 Avian Egypt 2008

(SEQ ID NO. 154)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

-continued

IENLNKKMEDGFLDVWTYNAELLVLMENERTLDFHDSNVKNLYDKVRLQLRDNAKELGNGCFEFYHRCDNEC
MESVRNGTYDYPQYSEEARLKREEISGVKLESIGTYQILSIYSTVASSLALAIMVAGLFLWMCSNGSLQCRI
CI

>AEA92628 Avian Egypt 2008 (SEQ ID NO. 155)
MEKIVLLLAIVSLVKSDQICIGYHANNSTEQVDTIMEKNVTVTHAQDILEKTHNGKLCNLDGVKPLIL
RDCSVAGWLLGNPMCDEFLNVPEWSYIVEKINPANDLCYPGNFNDYEELKHLLSRINHFEKIQIIPKNSWSD
HETSGVSSACPYQGRSSFFRNVVWLTKKDNAYPTIKRSYNNTNQEDLLVLWGIHHPNDXAEQTRLYQNPTT
YISVGTSTLNQRLVPKIATRSKVNGQSGRMEFFWTILKSNDAINFESNGNFIAPENAYKIVKKGDSTIMKSE
LEYSNCNTKCQTPIGAINSSMPFHNIHPLTIGECPKYVKSNRLVLATGLRNSPQGERRRKKRGLFG
AIAGFIEGGWQGMVDGWYGYHHSNEQGSGYAADKESTQKAIDGVTNKVNSIIDKMNTQFEAVGREFNNLERR
IENLNKKMEDGFLDVWTYNAELLVLMENERTLDFHDSNVKNLYDKVRLQLRDNAKELGNGCFEFYHKCDNEC
MESVRNGTYDYPQYSEEARLKREEISGVKLESIGTYQILSIYSTVASSLALAIMVAGLFLWMCSNGSLQCRI
CI >ACR56247 Avian Egypt 2008 (SEQ ID NO. 156)
MEKIVLLLAIVSLVKSDQICIGYHANNSTEQVDTIMEKNVTVTHAQDILEKAHNGKLCNLDGVKPLIL
RDCSVAGWLLGNPMCDEFLNVPEWSYIVEKINPANDLCYPGNFNDYEELKHLLSRINHFEKIQIIPKNSWSD
HEASGVSSACPYQGRSSFFRNVVWLTKKDNAYPTIKRSYNNTNQEDLLILWGIHHPNDAAEQTRLYQNPTT
YISVGTSTLNQRLVPKIATRSKVNGQSGRMEFFWTILKSNDAINFESNGNFIAPENAYKIVKKGDSTIMKSE
LEYGNCNTKCQTPIGAINSSMPFHNIHPLTIGECPKYVKSNRLVLATGLRNSPQGERRRKKRGLFG
AIAGFIEGGWQGMVDGWYGYHHSNEQGSGYAADKESTQKAIDGVTNKVNSIIDKMNTQFEAVGREFNNLERR
IENLNKKMEDGFLDVWTYNAELLVLMENERTLDFHDSNVKNLYDKVRLQLRDNAKELGNGCFEFYHRCDNEC
MESVRNGTYDYPQYSEEARLKREEISGVKLESIGTYQILSIYSTVASSLALAIMVAGLFLWMCSNGSLQCRI
CI >ACX31965 Avian Egypt 2009 (SEQ ID NO. 157)
MEKIVLLLAIVSLVKSDQICIGYHANNSTEQVDTIMEKNVTVTHAQDILEKTHNGKLCNLDGVKPLIL
RDCSVAGWLLGNPMCDEFLNVPEWSYIVEKINPANDLCYPGNFNDYEELKHLLSRINHFEKIQIIPKNSWSD
HEASGVSSACPYQGRSSFFRNVVWLTKKDNAYPTIKRSYNNTNQEDLLVLWGIHHPNDAAEQTRLYQNPTT
YISVGTSTLNQRLVPKIATRSKVNGQSGRMEFFWTILKSNDAINFESNGNFIAPENAYKIVKKGDSTIMKSE
LEYSNCNTKCQTPIGAINSSMPFHNIHPLTIGECPKYVKSNRLVLATGLRNSPQGERRRKKRGLFG
AIAGFIEGGWQGMVDGWYGYHHSNEQGSGYAADKESTQKAIDGVTNKVNSIIDKMNTQFEAVGREFNNLERR
IENLNKKMEDGFLDVWTYNAELLVLMENERTLDFHDSNVKNLYDKVRLQLRDNAKELGNGCFEFYHRCDNEC
MESVRNGTYDYPQYSEEARLKREEISGVKLESIGTYQILSIYSTVASSLALAIMVAGLFLWMCSNGSLQCRI
CI >ADD21353/1565 Avian Egypt 2009 (SEQ ID NO. 158)
MEKIVLLLAIVSLVKSDQICIGYHANNSTEQVDTIMEKNVTVTHAQDILEKTHNGKLCNLDGVKPLIL
RDCSVAGWLLGNPMCDEFLNVPEWSYIVEKINPANDLCYPGNFNDYEELKHLLSRINHFEKIQIIPKNSWSD
HEASGVSSACPYQGRSSFFRNVVWLTKKDNAYPTIKRSYNNTNQEDLLVLWGIHHPNDAAEQTRLYQNPTT
YISVGTSTLNQRLVPKIATRSKVNGQSGRMEFFWTILKSNDAINFESNGNFIAPENAYKIVKKGDSTIMKSE
LEYGNCNTKCQTPIGAINSSMPFHNIHPLTIGECPKYVKSNRLVLATGLRNSPQGERRRKKRGLFG
AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

>ADD21367/1565 Avian Egypt 2009

(SEQ ID NO. 159)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYSNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

>ADD21378/1565 Avian Egypt 2009

(SEQ ID NO. 160)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKSNPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

>ACX31969 Avian Egypt 2009

(SEQ ID NO. 161)

MKKIVLLLAIVTLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLSLWMCSNGSLQCRI

CI

>ACX31970 Avian Egypt 2009

(SEQ ID NO. 162)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKSSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

-continued

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ACX31978 Avian Egypt 2009

(SEQ ID NO. 163)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLIPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ACX31989 Avian Egypt 2009

(SEQ ID NO. 164)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKNSAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYSNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGIYQILSIYSTVASSLALAIMVAGLFLWMCSNGSLQCRI

CI

>ACX31993 Avian Egypt 2009

(SEQ ID NO. 165)

MEKIVLLLAIVSIVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKNNAYPTIKRSYNNTNQEDLLVLWGIHHPNDAAEQTRLYQNPTT

YISVGTSTLNQRLVPKIATRSKVNEQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ADD21354/1565 Avian Egypt 2009

(SEQ ID NO. 166)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLIPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

-continued

MESVRNGTYDYPQYSEEARLKREEISGVKLESIGTYQILSIYSTVASSLALAIMVAGLFLWMCSNGSLQCRI

>ADD21355/1565 Avian Egypt 2009

(SEQ ID NO. 167)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQRERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

>ADD21361/1565 Avian Egypt 2009

(SEQ ID NO. 168)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTXNQRLIPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

>ADD21376/1559 Avian Egypt 2009

(SEQ ID NO. 169)

LLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPVNDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILRSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

>ADD21379/1565 Avian Egypt 2009

(SEQ ID NO. 170)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDDAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

>ADD21380/1565 Avian Egypt 2009

(SEQ ID NO. 171)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

-continued

HEASGVSSACPYQGRSSFFRNVVWITKKDNAYPTIRRSYNNTNQEDLLVLWGIHHPNDAAEQTRLYQNPTT

YISVGTSTLNQRLIPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

>ADD21371/1565 Avian Egypt 2009
(SEQ ID NO. 172)
MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGISSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYSNCNTKCQTPIGAINSSMPFHNIHPITIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

>ADD21377/1553 Avian Egypt 2009
(SEQ ID NO. 173)
LVKSDQICVGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLVTGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

>ADY16730 Avian Egypt 2009
(SEQ ID NO. 174)
MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDATEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ADY16731 Avian Egypt 2009
(SEQ ID NO. 175)
MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDATEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVTSSLALAIMVAGLFLWMCSNGSLQCRI

CI

>ACX31975 Avian Egypt 2009

(SEQ ID NO. 176)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGIFLWMCSNGSLQCRI

CI

>ACX31997/1553 Avian Egypt 2009

(SEQ ID NO. 177)

KSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNYWSD

HEASGVSSACPYQGRSSFFRNVVWLTKKNNAYPTIKRSYNNTNQEDLLVLWGIHHPNDAEEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNALERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ADD21359/1565 Avian Egypt 2009

(SEQ ID NO. 178)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKNNAYPTIKRSYNNTNQEDLLVLWGIHHPNDAAEQTRLYQNPTT

YISVGTSTLNQRLIPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVRLESIGTYQILSIYSTVASSLALAIMVAGLFLWMCSNGSLQCRI

>ADD21382/1565 Avian Egypt 2009

(SEQ ID NO. 179)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDATEQTRLYQNPTT

YISVGTSTLNQRLIPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQEERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

-continued

MESVRNGTYDYPQYSEEARLKREEISGVKLESIGTYQILSIYSTVASSLALAIMVAGLFLWMCSNGSLQCRI

>ADB77952/1561 Avian Egypt 2009

(SEQ ID NO. 180)

LLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNGPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ADB85109 Avian Egypt 2009

(SEQ ID NO. 181)

MEKMVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNGPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ADM85844 Avian Egypt 2009

(SEQ ID NO. 182)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKNSAYPTIKKSYNNTNQEDLLVLWGIHHPNDAEEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNALERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLSLWMCSNGSLQCRI

CI

>ADM85845 Avian Egypt 2009

(SEQ ID NO. 183)

MEKIVLLLAIVSIVKSDQICIGYHANNSTEQVDTIMEKNVTVTHAQDILEKTHNGKLCNLNGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKNNAYPTIKKSYNNTNQEDLLVLWGIHHPNDAAEQTKLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ADM85847 Avian Egypt 2010
(SEQ ID NO. 184)
MEKIVLLLAIVSLVKSDQICIGYHANNSTEQVDTIMEKNVTVTHAQDILEKTHNGKLCNLDGVKPLIL
RDCSVAGWLLGNPMCDEFLNVPEWSYIVEKINPANDLCYPGNFNDYEELKHLLSRINHFEKIQIIPKNSWSD
HEASGVSSACPYQGRSSFFRNVVWLTKKDNAYPTIKRSYNNTNQEDLLVLWGIHHPNDATEQTRLYQNPTT
YISVGTSTLNQRLVPKIATRSKVNGQSGRMEFFWTILKSNDAINFDSNGNFIAPENAYKIVKKGDSTIMKSE
LEYGNCNTKCQTPIGAINSSMPFHNIHPLTIGECPKYVKSNRLVLATGLRNSPQGERRRKKRGLFG
AIAGFIEGGWQGMVDGWYGYHHSNEQGSGYAADKESTQKAIDGVTNKVNSIIDKMNTQFEAVGREFNNLERR
IENLNKKMEDGFLDVWTYNAELLVLMENERTLDFHDSNVKNLYDKVRLQLRDNAKELGNGCFEFYHRCDNEC
MESVRNGTYDYPQYSEEARLKREEISGVKLESIGTYQILSIYSTVASSLALAIMVAGLFLWMCSNGSLQCRI
CI >ADM85852 Avian Egypt 2010
(SEQ ID NO. 185)
MEKIVLLLAIVSIVKSDQICIGYHANNSTEQVDTIMEKNVTVTHAQDILEKTHNGKLCNLDGVKPLIL
RDCSVAGWLLGNPMCDEFLNVPEWSYIVEKINPANDLCYPGNFNDYEELKHLLSRINHFEKIQIIPKNSWSD
HEASGVSSACPYQGRSSFFRNVVWLTKKNNAYPTIKKSYNNTNQEDLLVLWGIHHPNDAAEQTRLYQNPTT
YISVGTSTLNQRLVPKIATRPKVNGQSGRMEFFWTILKSNDAINFESNGNFIAPENAYKIVKKGDSTIMKSE
LEYGNCNTKCQTPIGAINSSMPFHNIHPLTIGECPKYVKSNRLVLATGLRNSPQGERRRKKRGLFG
AIAGFIEGGWQGMVDGWYGYHHSNEQGSGYAADKESTQKAIDGVTNKVNSIIDKMNTQFEAVGREFNNLERR
IENLNKKMEDGFLDVWTYNAELLVLMENERTLDFHDSNVKNLYDKVRLQLRDNAKELGNGCFEFYHRCDNEC
MESVRNGTYDYPQYSEEARLKREEISGVKLESIGTYQILSIYSTVASSLALAIMVAGLFLWMCSNGSLQCRI
CI >ADM85854 Avian Egypt 2010
(SEQ ID NO. 186)
MEKIVLLLAIVSIVKSDQICIGYHANNSTEQVDTIMEKNVTVTHAQDILEKTHNGKLCNLDGVKPLIL
RDCSVAGWLLGNPMCDEFLNVPEWSYIVEKINPANDLCYPGNFNDYEELKHLLSRINHFEKIQIIPKNSWSD
HEASGVSSACPYQGRSSFFRNVVWLTKKNNAYPTIKKSYNNTNQEDLLVLWGIHHPNDAAEQTRLYQNPTT
YISVGTSTLNQRLVPKIANRSKVNGQSGRMEFFWTILKSNDAINFESNGNFIAPENAYKIVKKGDSTIMKSE
LEYGNCNTKCQTPIGAINSSMPFHNIHPLTIGECPKYVKSNRLVLATGLRNSPQGERRRKKRGLFG
AIAGFIEGGWQGMVDGWYGYHHSNEQGSGYAADKESTQKAIDGVTNKVNSIIDKMNTQFEAVGREFNNLERR
IENLNKKMEDGFLDVWTYNAELLVLMENERTLDFHDSNVKNLYDKVRLQLRDNAKELGNGCFEFYHRCDNEC
MESVRNGTYDYPQYSEEARLKREEISGVKLESIGTYQILSIYSTVASSLALAIMVAGLFLWMCSNGSLQCRI
CI >ADM85855 Avian Egypt 2010
(SEQ ID NO. 187)
MEKIVLLLAIVSIVKSDQICIGYHANNSTEQVDTIMEKNVTVTHAQDILEKTHNGKLCNLDGVKPLIL
RDCSVAGWLLGNPMCDEFLNVPEWSYIVEKINPANDLCYPGNFNDYEELKHLLSRINHFEKIQIIPKNSWSD
HEASGVSSACPYQGRSSFFRNVVWLTKKDNAYPTIKRSYNNTNQEDLLVLWGIHHPNDAAEQTRLYQNPTT
YISVGTSTLNQRLVPKIATRSKVNGQSGRMEFFWTILKSNDAINFESNGNFIAPENAYKIVKKGDSTIMKSE
LEYGNCNTKCQTPIGAINSSMPFHNIHPLTIGECPKYVKSNRLVLATGLRNSPQGERRRKKRGLFG
AIAGFIEGGWQGMVDGWYGYHHSNEQGSGYAADKESTQKAIDGVTNKVNSIIDKMNTQFEAVGREFNNLERR
IENLNKKMEDGFLDVWTYNAELLVLMENERTLDFHDSNVKNLYDKVRLQLRDNAKELGNGCFEFYHRCDNEC
MESVRNGTYDYPQYSEEARLKREEISGVKLESIGTYQILSIYSTVASSLALAIMVAGLFLWMCSNGSLQCRI
CI -continued >ADM85856/1557 Avian Egypt 2010

(SEQ ID NO. 188)
VSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDATEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGDRRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ADM85861 Avian Egypt 2010
(SEQ ID NO. 189)
MEKIVLLLAIFSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ADM85862 Avian Egypt 2010
(SEQ ID NO. 190)

MEKIVLLLAIVSIVKSDQICIGYHANNSTEQVDTIMEKNVTVTHAQDILEKTHNGKLCNLDGVKPLIL

RDCSVAGWLLGNPMCDEFLNVPEWSYIVEKINPTNDLCYPGNFNDYEELKHLLSRINHFEKIQIIPKNSWSD

HEASGVSSACPYQGRSSFFRNVVWLTKKNNAYPTIKKSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ADM85863 Avian Egypt 2010

(SEQ ID NO. 191)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYPTIKRSYNNTNQEDLLVLWGIHHPNDATEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGDRRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

-continued

>ADM85868 Avian Egypt 2010

(SEQ ID NO. 192)

MEKIVLLLAIVSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HGASGVSSACPYQGRSSFFRNVVWLTKKDNAYPTIKKSYNNTNQEDLLILWGIHHPNDAAEQTRLYQNPTT

YISVGTSTLNQRLVPKIATRSKVNGQSGRMEFFWTILKPNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ADM85870 Avian Egypt 2010

(SEQ ID NO. 193)

MEKIVLLLAIVSIVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKNNAYPTIKKSYNNTNQEDLLVLWGIHHPNDAVEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLVLAIIVAGLFLWMCSNGSLQCRI

CI

>ADM85871 Avian Egypt 2010

(SEQ ID NO. 194)

MEKIVLLLAIFSLVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKDNAYLTIKRSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

>ADM85873/1558 Avian Egypt 2010

(SEQ ID NO. 195)

IVSIVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKDSWSD

HEASGVSSACPYQGRSSFFRNVVWLTKRNNAYPTIKKSYNNTNQEDLLVLWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYGNCNTKCQTPIGAINSSMPFHNIHPLTIGECPKYVKSNRLVLATGLRNSPQGERRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLALAIMVAGLFLWMCSNGSLQCRI

CI

```
>ADM85874 Avian Egypt 2010
                                                       (SEQ ID NO. 196)
MEKIVLL -continued >ADM85884 Avian Egypt 2010
(SEQ ID NO. 200)
MEKIV -continued >AEN68621 Avian Israel 2011
(SEQ ID NO. 204)

MEKIVLLLAIVSIVKSDQICIGYHANNSTEQVDTIMEKNVTVTHAQDILEKTHNGKLCNLDGVKPLIL

RDCSVAGWLLGNPMCDEFLNVPEWSYIVEKINPANDLCYPGNFNDYEELKHLLSRINHFEKIQIIPKNSWSD

HEASGVSSACPYQGRSSFFRNVVWLTKKNDAYPTIKKSYNNTNQEDLLVIWGIHHPNDAAEQTRLYQNPTT

YISVGTSTLNQRLVPKIATRSKVNGQSGRMEFFWTILKSNDAINFESNGNFIAPENAYKIVKKGDSTIMKSE

LEYSNCNTKCQTPIGAINSSMPFHNIHPLTIGECPKYVKSNRLVLATGLRNSPQGEKRRKKRGLFG

AIAGFIEGGWQGMVDGWYGYHHSNEQGSGYAADKESTQKAIDGVTNKVNSIIDKMNTQFEAVGREFNNLERR

IENLNKKMEDGFLDVWTYNAELLVLMENERTLDFHDSNVKNLYDKVRLQLRDNAKELGNGCFEFYHRCDNEC

MESVRNGTYDYPQYSEEARLKREEISGVKLESIGTYQILSIYSTVASSLVLAIMVAGLFLWMCSNGSLQCRI

CI

Materials and Methods

Cloning, Baculovirus Synthesis, Expression and Purification of HA

H5 WT and mutant HA sequences were codon-optimized for insect cell expression and synthesized at DNA2.0 (Menlo Park, Calif.). The synthesized genes were then sub-cloned into pAcGP67A plasmid and baculoviruses were created using Baculogold system (BD Biosciences, San Jose, Calif.) according to manufacturer's instructions. The recombinant baculoviruses were then used to infect suspension cultures of Sf9 cells cultured in BD Baculogold Max-XP SFM (BD Biosciences, San Jose, Calif.). The infection was monitored and the conditioned media was harvested 3-4 days post-infection. The soluble HA from the harvested conditioned media was purified using Nickel affinity chromatography (HisTrap HP columns, GE Healthcare, Piscataway, N.J.). Eluting fractions containing HA were pooled, concentrated and buffer exchanged into 1×PBS pH 8.0 (Gibco) using 100K MWCO spin columns (Millipore, Billerica, Mass.). The purified protein was quantified using BCA method (Pierce).

Binding of Recombinant HA to Human Tracheal Tissue Sections

Paraffinized human tracheal (US Biological) tissue sections were deparaffinized, rehydrated and incubated with 1% BSA in PBS for 30 minutes to prevent non-specific binding. HA was pre-complexed with primary antibody (mouse anti 6×His tag (SEQ ID NO: 207), Abcam) and secondary antibody (Alexa fluor 488 goat anti mouse, Invitrogen) in a molar ratio of 4:2:1, respectively, for 20 minutes on ice. The tissue binding was performed over different HA concentrations by diluting the pre-complexed HA in 1% BSA-PBS. Tissue sections were then incubated with the HA-antibody complexes for 3 hours at RT. The tissue sections were counterstained by propidium iodide (Invitrogen; 1:100 in TBST). The tissue sections were mounted and then imaged using a confocal microscope (Zeiss LSM510 laser scanning confocal microscopy).

Dose Dependent Direct Binding of WT and Mutant HA

To investigate the multivalent HA-glycan interactions a streptavidin plate array comprising representative biotinylated α2→3 and α2→6 sialylated glycans was used as described previously. 3'SLN, 3'SLN-LN, 3'SLN-LN-LN are representative avian receptors. 6' SLN and 6' SLN-LN are representative human receptors. LN corresponds to lactosamine (Galβ1-4GlcNAc) and 3' SLN and 6' SLN respectively correspond to Neu5Acα2-3 and Neu5Acα2-6 linked to LN (FIG. 28). The biotinylated glycans were obtained from the Consortium of Functional Glycomics through their resource request program. Streptavidin-coated High Binding Capacity 384-well plates (Pierce) were loaded to the full capacity of each well by incubating the well with 50 μl of 2.4 μM of biotinylated glycans overnight at 4° C. Excess glycans were removed through extensive washing with PBS. The trimeric HA unit comprises of three HA monomers (and hence three RBS, one for each monomer). The spatial arrangement of the biotinylated glycans in the wells of the streptavidin plate array favors binding to only one of the three HA monomers in the trimeric HA unit. Therefore in order to specifically enhance the multivalency in the HA-glycan interactions, the recombinant HA proteins were pre-complexed with the primary and secondary antibodies in the molar ratio of 4:2:1 (HA:primary:secondary). The identical arrangement of 4 trimeric HA units in the precomplex for all the HAs permits comparison between their glycan binding affinities. A stock solution containing appropriate amounts of Histidine tagged HA protein, primary antibody (Mouse anti 6×His tag (SEQ ID NO: 207) IgG from Abcam) and secondary antibody (HRP conjugated goat anti Mouse IgG from Santacruz Biotechnology) in the ratio 4:2:1 and incubated on ice for 20 min. Appropriate amounts of precomplexed stock HA were diluted to 250 μl with 1% BSA in PBS. 50 μl of this precomplexed HA was added to each of the glycan-coated wells and incubated at room temperature for 3 hrs followed by the wash steps with PBS and PBST (1×PBS+0.05% Tween-20). The binding signal was determined based on HRP activity using Amplex Red Peroxidase Assay kit (Invitrogen, CA) according to the manufacturer's instructions.

Equivalents

Those skilled in the art will recognize, or be able to ascertain using no more than routine experimentation, many equivalents to embodiments of the invention described herein. The scope of the present invention is not intended to be limited to the above Description, but rather is as set forth in the following claims:

SEQUENCE LISTING (339 sequences)

SEQ ID NO: 1 - protein, 323 aa, Artificial Sequence
  Description of Artificial Sequence: Synthetic polypeptide
  NCBI influenza virus sequence
ENGTCYPGEFIDYEELREQLSSISSFEKFEIFPKASSWPNHETTKGVTAACSYSGASSFYRNLLWITKKGTSYPKLSKSYTNNKGKEVLVIWGVHHPPSVSEQQSLYQNADAYVSVGSSKYNRRFAPEIAARPEVRGQAGRMNYYWTLLDQGDTITFEATGNLIAPWYAFALNKGSDSGIITSDAPVHNCDTRCQTPHGALNSSLPFQNVHPITIGECPKYVKSTKLRMATGLRNVPSIQSRGLFGAIAGFIEGGWTGMIDGWYGYHHQNEQGSGYAADQKSTQNAIDGITSKVNSVIEKMNTQFTAVGKEFNNLERRIENLN

SEQ ID NO: 2 - protein, 323 aa, Artificial Sequence
  Description of Artificial Sequence: Synthetic polypeptide
  NCBI influenza virus sequence
ENGTCYPGDFIDYEELREQLSSVSSFEKFEIFPKTSSWPNHETTKGVTAACSYAGASSFYRNLLWLTKKGSSYPKLSKSYVNNKGKEVLVIWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSRGLFGAIAGFIEGGWTGMIDGWYGYHHQNEQGSGYAADQKSTQNAIDGITNKVNSVIEKMNTQFTAVGKEFNNLERRIENLN

SEQ ID NO: 3 - protein, 322 aa, Artificial Sequence
  Description of Artificial Sequence: Synthetic polypeptide
  NCBI influenza virus sequence
ENGTCYPGYFADYEELREQLSSVSSFERFEIFPKESSWPNHTVTGVSASCSHNGKSSFYRNLLWLTGKNGLYPNLSKSYVNNKEKEVLVIWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLN

SEQ ID NO: 4 - protein, 321 aa, Artificial Sequence
  Description of Artificial Sequence: Synthetic polypeptide
  NCBI influenza virus sequence
ANGLCYPGSFNDYEELKHLLTSVTHFEKVKILPRDQWTQHTTTGGSRACAVSGNPSFFRNMVWLTEKGSNYPIAKRSYNNTSGKQMLVIWGIHHPNDDTEQRTLYQNVGTYVSVGTSTLNKRSIPEIATRPKVNGQGGRMEFSWTLLETWDVINFESTGNLIAPEYGFKISKRGSSGIMKTEKTLENCETKCQTPLGAINTTLPFHNIHPLTIGECPKYVKSDRLVLATGLRNVPQIESRGLFGAIAGFIEGGWQGHVDGWYGYHHSNDQGSGYAADKESTQKAIDGITNKVNSVIEKMNTQFEAVGKEFNNLERRLENLN

SEQ ID NO: 5 - protein, 321 aa, Artificial Sequence
  Description of Artificial Sequence: Synthetic polypeptide
  NCBI influenza virus sequence
RDGLCYPGSFNDYEELKHLLSSVKHFEKVKILPKDRWTQHTTTGGSRACAVSGNPSFFRNMVWLTEKGSNYPVAKGSYNNTSGEQMLIIWGVHHPNDEKEQRTLYQNVGTYVSVGTSTLNKRSTPDIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNIPQIESRGLFGAIAGFIEGGWQGMIDGWYGYHHSNDQGSGYAADKESTQKAFDGITNKVNSVIEKMNTQFEAVGKEFSNLERRLENLN

SEQ ID NO: 6 - protein, 317 aa, Artificial Sequence
  Description of Artificial Sequence: Synthetic polypeptide
  NCBI influenza virus sequence
FSNCYPYDIPDYASLRSLVASSGTLEFITEGFTWTGVTQNGGSSACKRGPANGFFSRLNWLTKSESAYPVLNVTMPNNDNFDKLYIWGVHHPSTNQEQTDLYVQASGRVTVSTRRSQQTIIPNIGSRPWVRGQPGRISIYWTIVKPGDVLVINSNGNLIAPRGYFKMRTGKSSIMRSDAPIDTCISECITPNGSIPNDKPFQNVNKITYGACPKYVKQNTLKLATGMRNVPGKQTRGLFGAIAGFIENGWEGMIDGWYGFRHQNSEGTGQAADLKSTQAAIDQINRKLNRVIEKTNEKFHQIEKEFSEVEGRIQDLE

SEQ ID NO: 7 - protein, 317 aa, Artificial Sequence
  Description of Artificial Sequence: Synthetic polypeptide
  NCBI influenza virus sequence
FSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLE

SEQ ID NO: 8 - protein, 317 aa, Artificial Sequence
  Description of Artificial Sequence: Synthetic polypeptide
  NCBI influenza virus sequence
YSNCYPYDVPDYASLRSLVASSGTLEFNNESFNWAGVTQNGTSSACKRRSNKSFFSRLNWLTHLKYKYPALNVTMPNNEKFDKLYIWGVHHPVTDSDQISLYAQASGRITVSTKRSQQTVIPNIGYRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLE

SEQ ID NO: 9 - protein, 319 aa, Artificial Sequence
  Description of Artificial Sequence: Synthetic polypeptide
  NCBI influenza virus sequence
VDTCYPFDVPDYQSLRSILANNGKFEFIAEEFQWNTVKQNGKSGACKRANVNDFFNRLNWLTKSNGDAYPLQNLTKVNNGDYARLYIWGVHHPSTDTEQTDLYKNNPGRVTVSTKTSQTSVVPNIGSRPWVRGQSGRISFYWTIVDPGDIIVFNTIGNLIAPRGHYKLNSQKKSTILNTAVPIGSCVSKCHTDRGSITTTKPFQNISRISIGDCPKYVKQGSLKLATGMRNIPEKATRGLFGAIAGFIENGWQGLIDGWYGFRHQNAEGTGTAADLKSTQAAIDQINGKLNRLIEKTNEKYHQIEKEFEQVEGRIQDLE

SEQ ID NO: 10 - protein, 326 aa, Artificial Sequence
  Description of Artificial Sequence: Synthetic polypeptide
  NCBI influenza virus sequence
VNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLN

SEQ ID NO: 11 - protein, 326 aa, Artificial Sequence
  Description of Artificial Sequence: Synthetic polypeptide
  NCBI influenza virus sequence
ANDLCYPGDFNDYEELKHLLSRINHFEKIQIIPKNSWSSHEASLGVSSACPYQGKSSFFRNVVWLIKKNNAYPTIKRSYNNTNQEDLLVLWGIHHPNDAAEQTRLYQNPTTYISVGTSTLNQRLVPKIATRSKVNGQNGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLN

SEQ ID NO: 12 - protein, 324 aa, Artificial Sequence
  Description of Artificial Sequence: Synthetic polypeptide
  NCBI influenza virus sequence
QNGICYPGTLNEIEELKALIGSGERIERFEMFPKSTWSGVNTNNGVTRACPDNSGSSFYRNLLWITKTNSAAYPVIKGTYNNTGNQPILYFWGVHHPPDTNAQNNLYGSGDRYVRMGTESMNFAKGPEISARPVVNGQRGRIDYYWSVLKPGETLNVESNGNLIAPWYAYKFVSTNSKGAVFKSNLPIENCDATCQTIAGVLRTNKTFQNVSPLWIGKCPKYVKSESLRLATGLRNVPQIATRGLFGAIAGFIEGGWTGLVDGWYGYHHENSQGSGYAADRESTQKAIDGITNKVNSIIDKMNTQFEAVDHEFSNLERRIDNMN

SEQ ID NO: 13 - protein, 319 aa, Artificial Sequence
  Description of Artificial Sequence: Synthetic polypeptide
  NCBI influenza virus sequence
SDVCYPGKFVNEEALRQILRESGGINKETMGFTYSGIRTNGATSTCRRSGSSFYAEMKWLLSNTDNAAFPQMTKSYKNTRKDPALIIWGIHHSGSTTEQTKLYGSGNKLITVESSNYQQSFVPSPGARPKVDGQSGRIDFHWLMLNPNDTITFSFNGAFIAPDRASFLRGKSMGIQSGVQVDDNCEGDCYHSGGTIISNLPFQNINSRAVGKCPRYVKQESLMLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVI

SEQ ID NO: 14 - protein, 323 aa, Artificial Sequence
  Description of Artificial Sequence: Synthetic polypeptide
  NCBI influenza virus sequence
PEGMCYPGSVENLEELRFVFSSAASYKRIRLFDYSRWNVTRSGTSKACNASTGGQSFYRSINWLTKKKPDTYDFNEGAYVNNEDGDIIFLWGIHHPPDTKEQTTLYKNANTLSSVTTNTINRSFQPNIGPRPLVRGQQGRMDYYWGILKRGETLKIRTNGNLIAPEFGYLLKGESYGRIIQNEDIPIGNCNTKCQTYAGAINSSKPFQNASRHYMGECPKYVKKASLRLAVGLRNTPSVEPRGLFGAIAGFIEGGWSGMIDGWYGFHHSNSEGTGMAADQKSTQEAIDKITNKVNNIVDKMNREFEVVNHEFSEVEKRINMIN

SEQ ID NO: 15 - protein, 316 aa, Artificial Sequence
  Description of Artificial Sequence: Synthetic polypeptide
  NCBI influenza virus sequence
VNGTCYPGNVENLEELRTLFSSASSYQRIQIFPDTIWNVTYTGTSKACSGSFYRSMRWLTQKSGSYPVQDAQYTNNREKSILFVWGIHHPPTDTAQTNLYINTDTTTSVTTEDLNRIFKPVIGPRPLVNGLQGRINYYWSLVKPGQTLRVRSNGNLIAPWYGHVLSGGSHGRILKTDLNSGNCVVQCQTEKGGLMSTLPFHNISKYAFGICPKYVRVKSLKLAVGLRNVPARSNRGLFGAIAGFIEGGWPGLVAGWYGFQHSNDQGVGMAADRDSTQRAIDKITSKVNNIVDKMNKQYEIIDHEFSEVETRLNMIN

SEQ ID NO: 16 - protein, 321 aa, Artificial Sequence
  Description of Artificial Sequence: Synthetic polypeptide
  NCBI influenza virus sequence
IAYCYPGATVNEEALRQKIMESGGIDKISTGFTYGSSINSAGTTRSCMRSGGNSFYAELKWLVSKNKGQNFPQTANTYRNTDSAEHLIIWGIHHPSSTQEKNDLYGTQSLSISVGSSTYQNNFVPVVGARPQVNGQSGRIDFHWTMVQPGDNITFSHNGGLIAPSRVSKLKGRGLGIQSGASVDNDCESKCFWKGGSINTKLPFQNLSPRTVGQCPKYVNKKSLLLATGMRNVPEVVQGRGLFGAIAGFIENGWEGMVDGWYGFRHQNAQGTGQAADYKSTQAAIDQITGKLNRLIEKTNTEFESIESEFSEIEHQIGNVI

SEQ ID NO: 17 - protein, 322 aa, Artificial Sequence
  Description of Artificial Sequence: Synthetic polypeptide
  NCBI influenza virus sequence
TNGICYPGTLENEEELRLKFSGVLEFSKFEAFTSNGWGAVNSGAGVTAACKFGSSNSFFRNMIWLIHQSGTYPVIRRTFNNTKGRDVLVVWGVHHPATLKEHQDLYKKDSSYVAVDSESYNRRFTPEISTRPKVNGQAGRMTFYWTIVKPGEAITFESNGAFLAPRYAFELVSLGNGKLFRSDLNIESCSTKCQSEIGGINTNRSFHNVHRNTIGDCPKYVNVKSLKLATGLRNVPAIATRGLFGAIAGFIEGGWPGLINGWYGFQHRNEEGTGIAADKESTQKAIDQITSKVNNIVDRMNTNFESVQHEFSEIEERINQLS

SEQ ID NO: 18 - protein, 321 aa, Artificial Sequence
  Description of Artificial Sequence: Synthetic polypeptide
  NCBI influenza virus sequence
MEGVCYPGSIENQEELRSLFSSIKKYERVKMFDFTKWNVTYTGTSRACNNTSNRGSFYRSMRWLTLKSGQFPVQTDEYKNTRDSDILFTWAIHHPPTSAEQVQLYKNPDTLSSVTTDEINRSFKPNIGPRPLVRGQQGRMDYYWAVLKPGQTVKIQTNGNLIAPEYGHLITGKSHGRILKNNLPVGQCVTECQLNEGVMNTSKPFQNTSKHYIGKCPKYIPSGSLKLAIGLRNVPQVQNRGLFGAIAGFIEGGWPGLVAGWYGFQHQNAEGTGMAADRDSTQKAIDNMQNKLNNVIDKMNKQFEVVNHEFSEVESRINMIN

SEQ ID NO: 19 - protein, 321 aa, Artificial Sequence
  Description of Artificial Sequence: Synthetic polypeptide
  NCBI influenza virus sequence
PHGLCYPGELNNNGELRHLFSGIRSFSRTELIPPTSWGEVLDGATSACRDDKGTNSFYRNLVWFVKKNNRYPVISKTYNNTTGRDVLVLWGIHHPVSVEETKTLYVNSDPYTLVSTKSWSEKYKLETGVRPGYNGQRSWMKIYWSLLHPGEMITFESNGGLLAPRYGYIIEEYGKGRIFQSRIRMSKCNTKCQTSVGGINTNRTFQNIDKNALGDCPKYIKSGQLKLATGLRNVPAISNRGLLGAIAGFIEGGWPGLINGWYGFQHQNEQGTGIAADKESTQKAIDQITTKINNIIDKMNGNYDSIRGEFNQVEKRINMLA

SEQ ID NO: 20 - protein, 319 aa, Artificial Sequence
  Description of Artificial Sequence: Synthetic polypeptide
  NCBI influenza virus sequence
VDTCYPFDVPDYQSLRSILASSGSLEFIAEQFTWNGVKVDGSSSACLRGGRNSFFSRLNWLTKETNGNYGPINVTKENTGSYVRLYLWGVHHPSSDNEQTDLYKVATGRVTVSTRSDQISIVPNIGSRPRVRNQSGRISIYWTLVNPGDSIIFNSIGNLIAPRGHYKISKSTKSTVLKSDKRIGSCTSPCLTDKGSIQSDKPFQNVSRIAIGNCPKYVKQGSLMLATGMRNIPGKQAKGLFGAIAGFIENGWQGLIDGWYGFRHQNAEGTGTAADLKSTQAAIDQINGKLNRLIEKTNEKYHQIEKEFEQVEGRIQDLE

SEQ ID NO: 21 - protein, 329 aa, Artificial Sequence
  Description of Artificial Sequence: Synthetic polypeptide
  NCBI influenza virus sequence
SDICYPGKFTNEEALRQIIRESGGIDKEPMGFRYSGIKTDGATSACKRTVSSFYSEMKWLLSSKANQVFPQLNQTYRNNRKEPALIVWGVHHSSSLDEQNKLYGAGNKLITVGSSKYQQSFSPSPGDRPKVNGQAGRIDFHWMLLDPGDTVTFTFNGAFIAPDRATFLRSNAPSGVEYNGKSLGIQSDAQIDESCEGECFYSGGTINSPLPFQNIDSWAVGRCPRYVKQSSLPLALGHKNVPEKIHTRGLFGAIAGFIENGWEGLIDGWYGFRHQNAQGQGTAADYKSTQAAIDQITGKLNRLIEKTNTQFELIDNEFTEVEQQIGNVI

SEQ ID NO: 22 - protein, 320 aa, Artificial Sequence
  Description of Artificial Sequence: Synthetic polypeptide
  NCBI influenza virus sequence
PNKLCFPGELDNNGELRHLFSGVNSFSRTELISPNKWGDILDGVTASCRDNGASSFYRNLVWIVKNKNGKYPVIKGDYNNTTGRDVLVLWGIHHPDTETTAINLYASKNPYTLVSTKEWSKRYELEIGTRIGDGQRSWMKLYWHLMRPGERIMFESNGGLIAPRYGYIIEKYGTGRIFQSGVRMAKCNTKCQTSLGGINTNKTFQNIERNALGDCPKYIKSGQLKLATGLRNVPSVGERGLFGAIAGFIEGGWPGLINGWYGFQHQNEQGTGIAADKASTQKAIDEITTKINNIIEKMNGNYDSIRGEFNQVEKRINMLA

SEQ ID NO: 23 - protein, 164 aa, Artificial Sequence
  Description of Artificial Sequence: Synthetic polypeptide
  HA glycan binding domain sequence
SYIIETSNSENGTCYPGEFIDYEELREQLSSISSFEKFEIFPKASSWPNHETTKGVTAACSYSGASSFYRNLLWITKKGTSYPKLSKSYTNNKGKEVLVLWGVHHPPSVSEQQSLYQNADAYVSVGSSKYNRRFAPEIAARPEVRGQAGRMNYYWTLLDQGDTI

SEQ ID NO: 24 - protein, 164 aa, Artificial Sequence
  Description of Artificial Sequence: Synthetic polypeptide
  HA glycan binding domain sequence
SYIVETSNSDNGTCYPGDFIDYEELREQLSSVSSFEKFEIFPKTSSWPNHETTRGVTAACPYAGASSFYRNLLWLVKKGNSYPKLSKSYVNNKGKEVLVLWGVHHPPTSTDQQSLYQNADAYVSVGSSKYDRRFTPEIAARPKVRSQAGRMNYYWTLLEPGDTI

SEQ ID NO: 25 - protein, 163 aa, Artificial Sequence
  Description of Artificial Sequence: Synthetic polypeptide
  HA glycan binding domain sequence
SYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPNVRDQAGRMNYYWTLLKPGDTI

SEQ ID NO: 26 - protein, 164 aa, Artificial Sequence
  Description of Artificial Sequence: Synthetic polypeptide
  HA glycan binding domain sequence
SYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGIDQQSLYQNADAYVSVGSSKYNRRFTPEIAARPKVRDQAGRMNYYWTLLEPGDTI

SEQ ID NO: 27 - protein, 164 aa, Artificial Sequence
  Description of Artificial Sequence: Synthetic polypeptide
  HA glycan binding domain sequence
SYIAETPNPENGTCYPGYFADYEELREQLSSVSSFERFEIFPKESSWPNHTVTKGVTTSCSHNGKSSFYRNLLWLTKKNGLYPNVSKSYVNNKEKEVLVLWGVHHPSNISDQRAIYHTENAYVSVVSSHYSRRFTPEIAKRPKVRDQEGRINYYWTLLEPGDTI

SEQ ID NO: 28 - protein, 164 aa, Artificial Sequence
  Description of Artificial Sequence: Synthetic polypeptide
  HA glycan binding domain sequence
SYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVAVGSSKYNRRFTPEIAARPKVRDQAGRMNYYWTLLEPGDTI

SEQ ID NO: 29 - protein, 159 aa, Artificial Sequence
  Description of Artificial Sequence: Synthetic polypeptide
  HA glycan binding domain sequence
DLFVERSNAFSNCYPYDIPDYASLRSLVASSGTLEFITEGFTWTGVTQNGGSSACKRGPANGFFSRLNWLTKSESAYPVLNVTMPNNDNFNKLYIWGVHHPSTNQEQTNLYVQASGRVTVSTRRSQQTIIPNIGSRPWVRGQPGRISIYWTIVKPGDVL

SEQ ID NO: 30 - protein, 159 aa, Artificial Sequence
  Description of Artificial Sequence: Synthetic polypeptide
  HA glycan binding domain sequence
DLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGARPWVRGLSSRISIYWTIVKPGDVL

SEQ ID NO: 31 - protein, 159 aa, Artificial Sequence
  Description of Artificial Sequence: Synthetic polypeptide
  HA glycan binding domain sequence
DLFVERSKAYSNCYPYDVPDYASLRSLVASSGTLEFNNESFNWTGVAQNGTSSSCKRRSIKSFFSRLNWLHQLKYRYPALNVTMPNNDKFDKLYIWGVHHPSTDSDQTSLYTQASGRVTVSTKRSQQTVIPNIGSRPWVRGISSRISIYWTIVKPGDIL

SEQ ID NO: 32 - protein, 163 aa, Artificial Sequence
  Description of Artificial Sequence: Synthetic polypeptide
  HA glycan binding domain sequence
SYIVEKDNPVNGLCYPENFNDYEELKHLLSSTNHFEKIRIIPRSSWSNHDASSGVSSACPYNGRSSFFRNVVWLIKKNNAYPTIKRSYNNTNQEDLLILWGIHHPNDAAEQTKLYQNPTTYVSVGTSTLNQRSVPEIATRPKVNGQSGRMEFFWTILKPNDAI

SEQ ID NO: 33 - protein, 163 aa, Artificial Sequence
  Description of Artificial Sequence: Synthetic polypeptide
  HA glycan binding domain sequence
SYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLYLWGIHHPNDAAEQTKLYQNPTTYISVGTSTLNQRLVPRIATRSKVNGQSGRMEFFWTILKPNDAI

SEQ ID NO: 34 - protein, 568 aa, Artificial Sequence
  Description of Artificial Sequence: Synthetic polypeptide
  Sequence alignment illustrating conserved subsequences characteristic of H5 HA.
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGDFNDYEELKELLSRINHFEKIQIIPKSSWSDHEASSGVSSACPYQGKSSFFRNVVWLIKKNSAYPTIKRSYNNTNQEDLLVLWGIHHPNDAAEQTKLYQNPTTYISVGTSTLNQRLVPKIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 35 - protein, 568 aa, Artificial Sequence
  Description of Artificial Sequence: Synthetic polypeptide
  Sequence alignment illustrating conserved subsequences characteristic of H5 HA.
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKASPDNDLCYPGDFNDYEELKELLSRINHFEKIQIIPKSSWSNHEASSGVSSACPYHGKSSFFRNVVWLIKKNSAYPTIKRSYNNTNQEDLLVLWGIHHPNDAAEQTKLYQNPTTYISVGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNTPQREGRRKKRGLFGAIAGFIEGGWQGMVDGWYGYHHSNEQGSGYAADKESTQKAIDGVTNKVNSIIDKMNTQFEAVGREFNKLERRIENLNKKMEDGFLDVWTYNAELLVLMENERTLDFHDSNVKNLYDKVRLQLRDNAKELGNGCFEFYHKCDNECMESVKNGTYDYPQYSEEARLNREEISGVKLESMGTYQILSIYSTVASSLALAIMVAGLSLWMCSNGSLQCRICI

SEQ ID NO: 36 - protein, 556 aa, Artificial Sequence
  Description of Artificial Sequence: Synthetic polypeptide
  Sequence alignment illustrating conserved subsequences characteristic of H5 HA.
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKELLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWM

SEQ ID NO: 37 - protein, 568 aa, Artificial Sequence
  Description of Artificial Sequence: Synthetic polypeptide
  Sequence alignment illustrating conserved subsequences characteristic of H5 HA.
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKELLSRINHFEKIQIIPKSSWSSHEASLGVSSACPYQGKPSFFRNVVWLIKKNSTYPTIKRSYNNTNQEDLVVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQREKRRKKRGLFGAIAGFIEGGWQGMVDGWYGYHHSNKQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 38 - protein, 564 aa, Artificial Sequence
  Description of Artificial Sequence: Synthetic polypeptide
  Sequence alignment illustrating conserved subsequences characteristic of H5 HA.
MERIVIALAIISIVKGDQICIGYHANNSTKQVDTIMEKNVTVTHAQDILEKEHNGKLCSLKGVRPLIKRDCSVAGWLLGNPMCDEFLNVPEWSYIVEKDNPINGLCYPGDFNDYEELKELMSSTNHFEKIQIIPRSSWSNHDASSGVSSACPYNGRSSFFRNVVWLIKKNNAYPTIKRTYNNTNIEDLLILWGIHHPNDAAEQTKLYQNSNTYVSVGTSTLNQRSIPEIATRPKVNGQSGRMEFFWTILKPNDAISFESNGNFIAPEYAYKIVKKGDSAIMKSELEYGNCDTKCQTPVGAINSSMPFHNVHPLTIGECPKYVKSDKLVLATGLRNVPQRETRGLFGAIAGFIEGGWQGMVDGWYGYHHSNEQGSGYAADKESTQKAIDGITNKVNSIIDKMNTQFETVGKEFNNLERRIENLNKKMEDGFLDVWTYNAELLVLMENERTLDFHDSNVKNLYDKVRLQLRDNAKELGNGCFEFYHKCDNECMESVRNGTYDYPQYSEESRLNREEIDGVKLESMGTYQILSIYSTVASSLALAIMVAGLSFWMCSNGSLQCRICI

SEQ ID NO: 39 - protein, 567 aa, Artificial Sequence
  Description of Artificial Sequence: Synthetic polypeptide
  Sequence alignment illustrating conserved subsequences characteristic of H5 HA.
MEKIVLLLAIVSLVKSDQICIGYHANNSTEQVDTIMEKNVTVTHAQDILEKTHNGKLCDLDGVKPLIKRDCSVAGWLLGNPMCDEFINVPEWSYIVEKANPANDLCYPGIFNDYEELKELLSRINHFEKIQIIPKSSWSDHEASSGVSSACPYQGKSSFFRNVVWLIKKNSAYPTIKISYNNTNQEDLLVLWGIHHPNDAAEQTRLYQNPTTYISVGTSTLNQRLVPKIATRSKVNGQSGRMEFFWTILKPNDAVNFESNGNFIAPEYAYKIVKKGDSTIMKSELEYGDCNTKCQTPMGAINSSMPFHNIHPLTIGECPKYVKSNRLVLATGLRNSPQRERRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 40 - protein, 556 aa, Artificial Sequence
  Description of Artificial Sequence: Synthetic polypeptide
  Sequence alignment illustrating conserved subsequences characteristic of H5 HA.
VLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKELLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNG

SEQ ID NO: 41 - protein, 557 aa, Artificial Sequence
  Description of Artificial Sequence: Synthetic polypeptide
  Sequence alignment illustrating conserved subsequences characteristic of H5 HA.
FAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKELLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSVTM

SEQ ID NO: 42 - protein, 553 aa, Artificial Sequence
  Description of Artificial Sequence: Synthetic polypeptide
  Sequence alignment illustrating conserved subsequences characteristic of H5 HA.
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKELLSRINHFEKIQIIPKSSWSDHEASSGVSSACPYLGKSSFFRNVVWLIKKNSAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGIYQILSIYSTVASSLALAIMMAGLS

SEQ ID NO: 43 - protein, 566 aa, Artificial Sequence
  Description of Artificial Sequence: Synthetic polypeptide
MEARLLVLLCAFAATNADTICIGYHANNSTDTVDTVLEKNVTVTHSVNLLEDSHNGKLCKLKGIAPLQLGKCNIAGWLLGNPECDLLLTASSWSYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSRGLFGAIAGFIEGGWTGMIDGWYGYHHQNEQGSGYAADQKSTQNAIDGITNKVNSVIEKMNTQFTAVGKEFNNLERRIENLNKKVDDGFLDIWTYNAELLVLLENERTLDFHDSNVRNLYEKVKSQLKNNAKEIGNGCFEFYHKCDDACMESVRNGTYDYPKYSEESKLNREEIDGVKLESMGVYQILAIYSTVASSLVLLVSLGAISFWMCSNGSLQCRICI

SEQ ID NO: 44 - protein, 565 aa, Artificial Sequence
  Description of Artificial Sequence: Synthetic polypeptide
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 45 - protein, 566 aa, Artificial Sequence
  Description of Artificial Sequence: Synthetic polypeptide
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 46 - protein, 562 aa, Artificial Sequence
  Description of Artificial Sequence: Synthetic polypeptide
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGLGSRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNRVNSVIEKMNTQFEAVGKEFSNLERRLENLNKKMEDGFLDVWTYNAELLVLMENERTLDFHDSNVKNLYDKVKMQLRDNVKELGNGCFEFYPKCDDECMNSVKNGTYDYPKYEEESKLNRNEIKGVKLSSMGVYQILAIYATVAGSLSLAIMMAGISFWMCSNGSLQCRICI

SEQ ID NO: 47 - protein, 566 aa, Artificial Sequence
  Description of Artificial Sequence: Synthetic polypeptide
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEEMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 48 - protein, 566 aa, Artificial Sequence
  Description of Artificial Sequence: Synthetic polypeptide
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSSCKRRSIKSFFSRLNWLHQLKYRYPALNVTMPNNDKFDKLYIWGVHHPSTDSDQTSLYTQASGRVTVSTKRSQQTVIPNIGSRPWVRGISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 49 - protein, 566 aa, Artificial Sequence
  Description of Artificial Sequence: Synthetic polypeptide
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 50 - protein, 568 aa, Artificial Sequence
  Description of Artificial Sequence: Synthetic polypeptide
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 51 - protein, 568 aa, Artificial Sequence
  Description of Artificial Sequence: Synthetic polypeptide
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 52 - protein, 552 aa, Artificial Sequence
  Description of Artificial Sequence: Synthetic polypeptide
MNTQILAFIACVLTGVKGDKICLGHHAVANGTKVNTLTERGIEVVNATETVETTNIKKICTQGKRPTDLGQCGLLGTLIGPPQCDQFLEFSSDLIIERREGTDICYPGRFTNEESLRQILRRSGGIGKESMGFTYSGIRTNGATSACTRSGSSFYAEMKWLLSNSDNAAFPQMTKAYRNPRNKPALIIWGVHHSESVSEQTKLYGSGNKLITVRSSKYQQSFTPNPGARRIDFHWLLLDPNDTVTFTFNGAFIAPDRTSFFRGESLGVQSDAPLDSSCRGDCFHSGGTIVSSLPFQNINSRTVGKCPRYVKQKSLLLATGMRNVPEKPKPRGLFGAIAGFIENGWEGLINGWYGFRHQNAQGEGTAADYKSTQSAIDQITGKLNRLIGKTNQQFELIDNEFNEIEQQIGNVINWTRDAMTEIWSYNAELLVAMENQHTIDLADSEMSKLYERVKKQLRENAEEDGTGCFEIFHKCDDQCMESIRNNTYDHTQYRTESLQNRIQIDPVKLSSGYKDIILWFSFGASCFLLLAIAMGLVFICIKNGNMQCTICI

SEQ ID NO: 53 - protein, 568 aa, Artificial Sequence
  Description of Artificial Sequence: Synthetic polypeptide
MEKIVLLLATVSLVKSDQICIGYHANNSTEQVDTIMEKNVTVTHAQDILERTHNGKLCDLNGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNTPQRERRRKKRGLFGAIAGFIEGGWQGMVDGWYGYHHSNEQGSGYAADKESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHKCDNECMESVKNGTYDYPQYSEEARLNREEISGVKLESMGTYQILSIYSTVASSLALAIMVAGLSLWMCSNGSLQCRICI

SEQ ID NO: 54 - protein, 568 aa, Artificial Sequence
  Description of Artificial Sequence: Synthetic polypeptide
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGDFNDYEELKHLLSRINHFEKIQIIPKNSWSSHEASLGVSSACPYQGKSSFFRNVVWLIKKNNAYPTIKRSYNNTNQEDLLVLWGIHHPNDAAEQTRLYQNPTTYISVGTSTLNQRLVPKIATRSKVNGQNGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 55 - protein, 568 aa, Artificial Sequence
  Description of Artificial Sequence: Synthetic polypeptide
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTMLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICI

SEQ ID NO: 56 - protein, 570 aa, Artificial Sequence
  Description of Artificial Sequence: Synthetic polypeptide
MRLVAKLLYLAVLAICGLGIHGALTHPRVTPPVYPSVSFNLTGADTYEPFLRALQEKVILGNHTAFDLPVLNPESQVSDSNRFVLVPLTNPSGDTVTLAIDVVNLYVVAFSSNGKSYFFSGSTAVQRDNLFVDTTQEELNFTGNYTSLERQVGFGRVYIPLGPKSLDQAISSLRTYTLTAGDTKPLARGLLVVIQMVSEAARFRYIELRIRTSITDASEFTPDLLMLSMENNWSSMSSEIQQAQPGGIFAGVVQLRDERNNSIEVTNFRRLFELTYIAVLLYGCAPVTSSSYSNNAIDAQIIKMPVFRGGEYEKVCSVVEVTRRISGWDGLCVDVRYGHYIDGNPVQLRPCGNECNQLWTFRTDGTIRWLGKCLTASSSVMIYDCNTVPPEATKWVVSIDGTITNPHSGLVLTAPQAAEGTALSLENNIHAARQGWTVGDVEPLVTFIVGYKQMCLRENGENNFVWLEDCVLNRVQQEWALYGDGTIRVNSNRSLCVTSEDHEPSDLIVILKCEGSGNQRWVFNTNGTISNPNAKLLMDVAQRDVSLRKIILYRPTGNPNQQWITTTHPA

SEQ ID NO: 57 - protein, 569 aa, Artificial Sequence
  Description of Artificial Sequence: Synthetic polypeptide
MKVVATILYLVVLAICGLGIHGAHPTHSAPPTVYPSVSFNLTEANSNEYRHFLQELRGKVILGSHRAFDLPVLNPESKVSDSDRFVLVRLTNPSRKKVTLAIDVVTFYVVAFAQNDRSYFFSGSSEVQRENLFVDTTQEDLNFKGDYTSLEHQVGFGRVYIPLGPKSLAQSISSLSTYKSSAGDNKRLARSLLVVIQMVSEAARFRYIQLRIQASITDAKEFTPDLLMLSMENKWSSMSSEIQQAQPGGAFAQVVKLLDQRNHPIDVTNFRRLFQLTSVAVLLHGCPTVTKMPAYIIKMPVFNGGEDEERCSVVEEVTRRIGGRDGFCAEVKNGDEKDGTPVQLSSCGEQSNQQWTFSTDGTIQSLGKCLTTSSSVMIYNCKVVPPESTKWVVSIDGTITNPRSGLVLTAPKAAEGTLVSLEKNVHAARQGWIVGNVEPLVTFIVGYEQMCLETNPGNNDVSLGDCSVKSASKVDQKWALYGDGTIRVNNDRSLCVTSEGKSSNEPIIILKCLGWANQRWVFNTDGTISNPDSKLVMHVDQNDVPLRKIILSHPSGTSNQQWIASTHPA

SEQ ID NO: 58 - protein, 286 aa, Artificial Sequence
  Description of Artificial Sequence: Synthetic polypeptide
MSFQGHGIYYIASAYVANTRLALSEDSSANKSPDVIISSDAVDPLNNLWLIEPVGEADTYTVRNAFAGSYMDLAGHAATDGTAIIGYRPTGGDNQKWIISQINDVWKIKSKETGTFVTLLNGDGGGTGTVVGWQNITNNTSQNWTFQKLSQTGANVHATLLACPALRQDFKSYLSDGLYLVLTRDQISSIWQASGLGSTPWRSEIFDCDDFATVFKGAVAKWGNENFKANGFALLCGLMFGSKSSGAHAYNWFVERGNFSTVTFFEPQNGTYSANAWDYKAYFGLF

SEQ ID NO: 59 - protein, 292 aa, Artificial Sequence
  Description of Artificial Sequence: Synthetic polypeptide
MSFEGHGIYHIPHAHVANIRMALANRGSGQNGTPVIAWDSNNDAFDHMWLVEPTGEADTYTIHNVSTGTYMDVTASAVADNTPIIGYQRTGNDNQKWIIRQVQTDGGDRPWKIQCKATGTFATLYSGGGSGTAIVGWRLVNSNGNQDWVFQKLSQTSVNVHATLLACGATVGQDFKNYLYDGLYLVLPRDRISAIWKASGLGETARRDGIYDSDEFAMTFKSAAATWGKENFKADGFAILCGMMFGTKASTNRHAYNWVVERGSFSTVTFFEPQNGTYSDDAWGYKAYFGLF

SEQ ID NO: 60 - protein, 568 aa, Artificial Sequence
  Description of Artificial Sequence: Synthetic polypeptide
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSDHEASSGVSSACPYQGKPSFFRNVVWLIKKNNTYPTIKRSYNNTNQEDLLVLWGIHHPNDAAEQTRLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 61 - protein, 567 aa, Artificial Sequence
  Description of Artificial Sequence: Synthetic polypeptide
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSDHTTTGGSRACPYQGKPSFFRNVVWLTKKNNTYPTIKRSYNNTNQEDLLVLWGIHHPNDEAEQRALYQNPTTYISVGTSTLNQRLVPRIATRPKVNGLGSRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 62 - protein, 567 aa, Artificial Sequence
  Description of Artificial Sequence: Synthetic polypeptide
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSDHTTTGGSRACPYQGKPSFFRNVVWLTKKNNAYPTIKRSYNNTNQEDLLVLWGIHHPNDEAEQRALYQNPTTYISVGTSTLNQRLVPRIATRPKVNGLGSRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 63 - protein, 567 aa, Artificial Sequence
  Description of Artificial Sequence: Synthetic polypeptide
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSDHASSGVSRACPYQGKPSFFRNVVWLIKKNNTYPTIKRSYNNTNQEDLLVLWGIHHPNDEAEQRALYQNPTTYISVGTSTLNQRLVPRIATRSKVNGLGSRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 64 - protein, 568 aa, Artificial Sequence
  Description of Artificial Sequence: Synthetic polypeptide
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSDHEASSGVSSACPYQGKPSFFRNVVWLIKKNNAYPTIKRSYNNTNQEDLLVLWGIHHPNDAAEQTRLYQNPTTYISVGTSTLNQRLVPRIATRSKVNGLSSRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 65 - protein, 568 aa, Artificial Sequence; identical to SEQ ID NO: 51
  Description of Artificial Sequence: Synthetic polypeptide

SEQ ID NO: 66 - protein, 568 aa, Artificial Sequence
  Description of Artificial Sequence: Synthetic polypeptide
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGLSSRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 67 - protein, 568 aa, Artificial Sequence
  Description of Artificial Sequence: Synthetic polypeptide
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGLSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 68 - protein, 568 aa, Artificial Sequence
  Description of Artificial Sequence: Synthetic polypeptide
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSDHEASSGVSSACPYQGKPSFFRNVVWLIKKNNAYPTIKRSYNNTNQEDLLVLWGIHHPNDAAEQTRLYQNPTTYISVGTSTLNQRLVPRIATRSKVNGLSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 69 - protein, 568 aa, Artificial Sequence
  Description of Artificial Sequence: Synthetic polypeptide
MEKIVLLLAIIGLVKSDQICVGYHANNSTEQVDTIMEKNITVTHAQDILEKTHNGKLCNLNGVKPLILKDCSVAGWLLGNPMCDEFLNVSEWSYIVEKASPANGLCYPGDFNDYEELKHLLSRINHFEKIKIIPKSYWSNHETSLGVSSACSYLENPSFFRNVVWLTKKNNTYPPIKVNYTNANQKDLLVLWGIHHPNNEAEQKMIYQNLNTYVSVGTSTLNQRLVPKIATRSKVNGQSGRMDFFWTILKPNDTINFDSNGNFIAPEYAYKIVKKGDSAIMKSELEYGNCNTKCQTPIGAINSSMPFHNIHPLTIGECPKYVKSNRLVLATGLRNAPQIEGRRRKRGLFGAIAGFIEGGWQGMVDGWYGYHHSNEQGSGYAADKESTQKAIDGITNKINSIIDKMNTQFEAVGREFNNLERRIENLNKKMEDGFLDVWTYNAELLVLMENERTLDFHDSNVKNLYEKVRLQLRDNAKELGNGCFEFYHKCDNECMESVKNGTYDYPQYSEEARLNREEISGVKLESIVTYQILSIYSTVASSLALAIMVAGLSLWMCSNGSLQCRICI

SEQ ID NO: 70 - protein, 567 aa, Artificial Sequence
  Description of Artificial Sequence: Synthetic polypeptide
MEKIVLLLAIIGLVKSDQICVGYHANNSTEQVDTIMEKNITVTHAQDILEKTHNGKLCNLNGVKPLILKDCSVAGWLLGNPMCDEFLNVSEWSYIVEKASPANGLCYPGDFNDYEELKHLLSRINHFEKIKIIPKSYWSNHTSTGVSRACSYLENPSFFRNVVWLTKKNNTYPPIKVNYTNANQKDLLVLWGIHHPNDEAEQKMIYQNLNTYVSVGTSTLNQRLVPKIATRSKVNGLGSRMDFFWTILKPNDTINFDSNGNFIAPEYAYKIVKKGDSAIMKSELEYGNCNTKCQTPIGAINSSMPFHNIHPLTIGECPKYVKSNRLVLATGLRNAPQIEGRRRKRGLFGAIAGFIEGGWQGMVDGWYGYHHSNEQGSGYAADKESTQKAIDGITNKINSIIDKMNTQFEAVGREFNNLERRIENLNKKMEDGFLDVWTYNAELLVLMENERTLDFHDSNVKNLYEKVRLQLRDNAKELGNGCFEFYHKCDNECMESVKNGTYDYPQYSEEARLNREEISGVKLESIVTYQILSIYSTVASSLALAIMVAGLSLWMCSNGSLQCRICI

SEQ ID NO: 71 - protein, 567 aa, Artificial Sequence
  Description of Artificial Sequence: Synthetic polypeptide
MEKIVLLLAIIGLVKSDQICVGYHANNSTEQVDTIMEKNITVTHAQDILEKTHNGKLCNLNGVKPLILKDCSVAGWLLGNPMCDEFLNVSEWSYIVEKASPANGLCYPGDFNDYEELKHLLSRINHFEKIKIIPKSYWSNHTSTGVSRACSYLENPSFFRNVVWLTKKNNTYPPIKVNYTNANQKDLLVLWGIHHPNNEAEQKMIYQNLNTYVSVGTSTLNQRLVPKIATRSKVNGLGSRMDFFWTILKPNDTINFDSNGNFIAPEYAYKIVKKGDSAIMKSELEYGNCNTKCQTPIGAINSSMPFHNIHPLTIGECPKYVKSNRLVLATGLRNAPQIEGRRRKRGLFGAIAGFIEGGWQGMVDGWYGYHHSNEQGSGYAADKESTQKAIDGITNKINSIIDKMNTQFEAVGREFNNLERRIENLNKKMEDGFLDVWTYNAELLVLMENERTLDFHDSNVKNLYEKVRLQLRDNAKELGNGCFEFYHKCDNECMESVKNGTYDYPQYSEEARLNREEISGVKLESIVTYQILSIYSTVASSLALAIMVAGLSLWMCSNGSLQCRICI

SEQ ID NO: 72 - protein, 567 aa, Artificial Sequence
  Description of Artificial Sequence: Synthetic polypeptide
MEKIVLLLAIIGLVKSDQICVGYHANNSTEQVDTIMEKNITVTHAQDILEKTHNGKLCNLNGVKPLILKDCSVAGWLLGNPMCDEFLNVSEWSYIVEKASPANGLCYPGDFNDYEELKHLLSRINHFEKIKIIPKSYWSNHTSTGVSRACSYLENPSFFRNVVWLTKKNNTYPPIKVNYTNANQKDLLVLWGIHHPNNEAEQKMIYQNLNTYVSVGTSTLNQRLVPKIATRSKVNGLGGRMDFFWTILKPNDTINFDSNGNFIAPEYAYKIVKKGDSAIMKSELEYGNCNTKCQTPIGAINSSMPFHNIHPLTIGECPKYVKSNRLVLATGLRNAPQIEGRRRKRGLFGAIAGFIEGGWQGMVDGWYGYHHSNEQGSGYAADKESTQKAIDGITNKINSIIDKMNTQFEAVGREFNNLERRIENLNKKMEDGFLDVWTYNAELLVLMENERTLDFHDSNVKNLYEKVRLQLRDNAKELGNGCFEFYHKCDNECMESVKNGTYDYPQYSEEARLNREEISGVKLESIVTYQILSIYSTVASSLALAIMVAGLSLWMCSNGSLQCRICI

SEQ ID NO: 73 - protein, 567 aa, Artificial Sequence
  Description of Artificial Sequence: Synthetic polypeptide
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTQISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKRRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 74 - protein, 567 aa, Artificial Sequence
  Description of Artificial Sequence: Synthetic polypeptide
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTQISVGTSTLNQRLVPKIATRSKVNGLSSRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKRRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 75 - protein, 567 aa, Artificial Sequence
  Description of Artificial Sequence: Synthetic polypeptide
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHTASGVSRACPYQGRSSFFRNVVWLTKKDNAYPTIKRSYNNTNQEDLLVLWGIHHPNDEAEQRALYQNPTTQISVGTSTLNQRLVPKIATRSKVNGLGSRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKRRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 76 - protein, 150 aa, Artificial Sequence
  Description of Artificial Sequence: Synthetic polypeptide
PANDLCYPGNFNDYEELKHLLSRINHFEKIQIIPKSSWSNHDASSGVSSACPYLGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILK

SEQ ID NO: 77 - protein, 150 aa, Artificial Sequence
  Description of Artificial Sequence: Synthetic polypeptide
PANDLCYPGNFNDYEELKHLLSRINHFEKIQIIPKSSWSDHEASSGVSSACPYQGKSSFFRNVVWLIKKNSAYPTIKRSYNNTNQEDLLVLWGIHHPNDAAEQTRLYQNPTTYISVGTSTLNQRLVPKIATRSKVNGQSGRMEFFWTILK

SEQ ID NO: 78 - protein, 150 aa, Artificial Sequence
  Description of Artificial Sequence: Synthetic polypeptide
PANDLCYPGDFNDYEELKHLLSRINHFEKIQIIPKNSWSSHEASLGVSSACPYQGKSSFFRNVVWLIKKNNAYPTIKRSYNNTNQEDLLVLWGIHHPNDAAEQTRLYQNPTTYISVGTSTLNQRLVPKIATRSKVNGQNGRMEFFWTILK

SEQ ID NO: 79 - protein, 150 aa, Artificial Sequence
  Description of Artificial Sequence: Synthetic polypeptide
PVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILK

SEQ ID NO: 80 - protein, 150 aa, Artificial Sequence; identical to SEQ ID NO: 79
  Description of Artificial Sequence: Synthetic polypeptide

SEQ ID NO: 81 - protein, 150 aa, Artificial Sequence
  Description of Artificial Sequence: Synthetic polypeptide
PTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILK

SEQ ID NO: 82 - protein, 150 aa, Artificial Sequence
  Description of Artificial Sequence: Synthetic polypeptide
PANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILK

SEQ ID NO: 83 - protein, 150 aa, Artificial Sequence
  Description of Artificial Sequence: Synthetic polypeptide
PANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILK

SEQ ID NO: 84 - protein, 150 aa, Artificial Sequence
  Description of Artificial Sequence: Synthetic polypeptide
PANDLCYPGDFNDYEELKHLLSRINHFEKIQIIPKSSWPNHEASLGVSSACPYLGESSFFRNVVWLIKKNSSYPTIKRSYNNTNQEDLLVLWGIHHPNDAAEQIKLYQNPNTYISVGTSTLNQRLVPTIATRSKVNGQSGRMEFFWTILK

SEQ ID NO: 85 - protein, 150 aa, Artificial Sequence
  Description of Artificial Sequence: Synthetic polypeptide
PANDLCYPGDFNDYEELKHLLSRINHFEKIQIIPKSSWSDYEASSGVSSACPYQGRSSFFRNVVWLIKKNNAYPTIKRSYNNTNQEDLLVLWGIHHPNDAAEQIRLYQNPTTYISVGTSTLNQRLVPKIATRSKVNGQSGRMEFFWTILK

SEQ ID NO: 86 - protein, 150 aa, Artificial Sequence
  Description of Artificial Sequence: Synthetic polypeptide
  MOD_RES (50)..(50): Any naturally occurring amino acid
PANDLCYPGNFNNYEELKHLLSRINRFEKIQIIPKSSWPDHEASLGVSSXCPYQGGPSFYRNVVWLIKKNNTYPTIKKSYHNTNQEDLLVLWGIHHPNDEAEQTRIYKNPTTYISVGTSTLNQRLVPKIATRSKVNGQSGRMEFFWTILK

SEQ ID NO: 87 - protein, 150 aa, Artificial Sequence
  Description of Artificial Sequence: Synthetic polypeptide
PANDLCYPGNFNDYEELKHLLSRINHFEKIQIIPKDSWSDHEASLGVSSACPYQGNSSFFRNVVWLIKKGNAYPTIKKSYNNTNQEDLLVLWGIHHPNDEAEQTRLYQNPTTYISTGTSTLNQRLVPKIATRSKVNGQSGRIDFFWTILK

SEQ ID NO: 88 - protein, 150 aa, Artificial Sequence
  Description of Artificial Sequence: Synthetic polypeptide
PANGLCYPGDFNDYEELKHLLSRINHLKKIKIIPKSYWSNHEASSGVSAACSYLGEPSFFRNVVWLIKKNNTYPPIKVNYTNTNQEDLLVLWGIHHPNDEKEQIRIYQNPNTSISVGTSTLNQRLVPKIATRPKVNGQSGRMEFFWTILK

SEQ ID NO: 89 - protein, 149 aa, Artificial Sequence
  Description of Artificial Sequence: Synthetic polypeptide
PRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGLGSRMEFSWTLLD

SEQ ID NO: 90 - protein, 150 aa, Artificial Sequence
  Description of Artificial Sequence: Synthetic polypeptide
PVNDLCYPGDFNDYEELKHLLSRINHFEKIQIIPKSSWSDHEASSGVSSACPYQGKPSFFRNVVWLIKKNNTYPTIKRSYNNTNQEDLLVLWGIHHPNDAAEQTRLYQNPTTYISVGTSTLNQRLVPRIATRSKVNGQSGRMEFFWTILK

SEQ ID NO: 91 - protein, 149 aa, Artificial Sequence
  Description of Artificial Sequence: Synthetic polypeptide
PVNDLCYPGDFNDYEELKHLLSRINHFEKIQIIPKSSWSDHTTTGGSRACPYQGKPSFFRNVVWLTKKNNTYPTIKRSYNNTNQEDLLVLWGIHHPNDEAEQRALYQNPTTYISVGTSTLNQRLVPRIATRPKVNGLGSRMEFFWTILK

SEQ ID NO: 92 - protein, 149 aa, Artificial Sequence
  Description of Artificial Sequence: Synthetic polypeptide
PVNDLCYPGDFNDYEELKHLLSRINHFEKIQIIPKSSWSDHASSGVSRACPYQGKPSFFRNVVWLIKKNNTYPTIKRSYNNTNQEDLLVLWGIHHPNDEAEQRALYQNPTTYISVGTSTLNQRLVPRIATRSKVNGLGSRMEFFWTILK

SEQ ID NO: 93 - protein, 149 aa, Artificial Sequence
  Description of Artificial Sequence: Synthetic polypeptide
PANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTQISVGTSTLNQRLVPKIATRSKVNGQSGRMEFFWTILK

SEQ ID NO: 94 - protein, 149 aa, Artificial Sequence
  Description of Artificial Sequence: Synthetic polypeptide
PANDLCYPGNFNDYEELKHLLSRINHFEKIQIIPKNSWSDHTASGVSRACPYQGRSSFFRNVVWLTKKDNAYPTIKRSYNNTNQEDLLVLWGIHHPNDEAEQRALYQNPTTQISVGTSTLNQRLVPKIATRSKVNGLGSRMEFFWTILK

SEQ ID NO: 95 - protein, 150 aa, Artificial Sequence
  Description of Artificial Sequence: Synthetic polypeptide
PANGLCYPGDFNDYEELKHLLSRINHFEKIKIIPKSYWSNHETSLGVSSACSYLENPAFFRNVVWLTKKNNTYPPIKVNYTNANQKDLLVLWGIHHPNNEAEQKMIYQNLNTYVSVGTSTLNQRLVPKIATRSKVNGQSGRMDFFWTILK

SEQ ID NO: 96 - protein, 149 aa, Artificial Sequence
  Description of Artificial Sequence: Synthetic polypeptide
PANGLCYPGDFNDYEELKHLLSRINHFEKIKIIPKSYWSNHTSTGVSRACSYLENPSFFRNVVWLTKKNNTYPPIKVNYTNANQKDLLVLWGIHHPNDEAEQKMIYQNLNTYVSVGTSTLNQRLVPKIATRSKVNGLGSRMDFFWTILK

SEQ ID NO: 97 - protein, 149 aa, Artificial Sequence
  Description of Artificial Sequence: Synthetic polypeptide
PANGLCYPGDFNDYEELKHLLSRINHFEKIKIIPKSYWSNHTSTGVSRACSYLENPSFFRNVVWLTKKNNTYPPIKVNYTNANQKDLLVLWGIHHPNNEAEQKMITQNLNTYVSVGTSTLNQRLVPKIATRSKVNGLGGRMDFFWTILK

SEQ ID NO: 98 - protein, 119 aa, Artificial Sequence
  Description of Artificial Sequence: Synthetic polypeptide
LSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGLGS

SEQ ID NO: 99 - protein, 119 aa, Artificial Sequence
  Description of Artificial Sequence: Synthetic polypeptide
LSRINHFEKIQIIPKNSWSDHEASGVSSACPYQGRSSFFRNVVWLTKKDNAYPTIKRSYNNTNQEDLLVLWGIHHPNDAAEQTRLYQNPTTQISVGTSTLNQRLVPKIATRSKVNGQSG

SEQ ID NO: 100 - protein, 119 aa, Artificial Sequence
  Description of Artificial Sequence: Synthetic polypeptide
LSRINHFEKIQIIPKNSWSDHEASGVSSACPYQGRSSFFRNVVWLTKKDNAYPTIKRSYNNTNQEDLLVLWGIHHPNDAAEQTRLYQNPTTQISVGTSTLNQRLVPKIATRSKVNGLSS

SEQ ID NO: 101 - protein, 120 aa, Artificial Sequence
  Description of Artificial Sequence: Synthetic polypeptide
LSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSG

SEQ ID NO: 102 - protein, 120 aa, Artificial Sequence
  Description of Artificial Sequence: Synthetic polypeptide
LSRINHFEKIQIIPKSSWSDHEASSGVSSACPYLGSPSFFRNVVWLIKKNSTYPTIKKSYNNTNQEDLLVLWGIHHPNDAAEQTMLYQNPTTYISIGTSTLNQRLVPKIATRSKVNGQSG

SEQ ID NO: 103 - protein, 120 aa, Artificial Sequence
  Description of Artificial Sequence: Synthetic polypeptide
LSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSG

SEQ ID NO: 104 - protein, 120 aa, Artificial Sequence
  Description of Artificial Sequence: Synthetic polypeptide
LSRINHFEKIQIIPKNSWSSHEASLGVSSACPYQGKSSFFRNVVWLIKKNNAYPTIKRSYNNTNQEDLLVLWGIHHPNDAAEQTRLYQNPTTYISVGTSTLNQRLVPKIATRSKVNGQNG

SEQ ID NO: 105 - protein, 119 aa, Artificial Sequence
  Description of Artificial Sequence: Synthetic polypeptide
LSRINHFEKIQIIPKSSWSNHDASSGVSSACPYLGRSSFFRNVVWLKKNSAYPTIKRSYNNTNQEDLLVLWGIHHPNDAAEQTKLYQNPTTYISVGTSTLNQRLVPEIATRPKVNGQSG

SEQ ID NO: 106 - protein, 106 aa, Artificial Sequence
  Description of Artificial Sequence: Synthetic polypeptide
  HA sequence element consensus sequence element
  MOD_RES (2)..(2): Tyr or Phe
  MOD_RES (4)..(48): Any amino acid
  MISC_FEATURE (4)..(48): This region may encompass 30-45 residues
  MOD_RES (50)..(69): Any amino acid
  MISC_FEATURE (50)..(69): This region may encompass 5-20 residues
  MOD_RES (71)..(100): Any amino acid
  MISC_FEATURE (71)..(100): This region may encompass 25-30 residues
  MOD_RES (102)..(103): Any amino acid
  See specification as filed for detailed description of substitutions and preferred embodiments
CXPXXXXXXXXXXXXXXXXXXXXXXXXXXXXXXXXXXXXXXXXXXXXXCXXXXXXXXXXXXXXXXXXXXWXXXXXXXXXXXXXXXXXXXXXXXXXXXXXXWXXHHP

SEQ ID NO: 107 - protein, 106 aa, Artificial Sequence
  Description of Artificial Sequence: Synthetic polypeptide
  HA sequence element consensus sequence element
  MOD_RES (4)..(45): Any amino acid
  MISC_FEATURE (4)..(45): This region may encompass 27-42 residues
  MOD_RES (47)..(47): Ala or Thr
  MOD_RES (48)..(48): Ala or Ser
  MOD_RES (50)..(69): Any amino acid
  MISC_FEATURE (50)..(69): This region may encompass 5-20 residues
  MOD_RES (71)..(100): Any amino acid
  MISC_FEATURE (71)..(100): This region may encompass 25-30 residues
  MOD_RES (102)..(103): Any amino acid
  See specification as filed for detailed description of substitutions and preferred embodiments
CYPXXXXXXXXXXXXXXXXXXXXXXXXXXXXXXXXXXXXXXXXXXTXXCXXXXXXXXXXXXXXXXXXXXWXXXXXXXXXXXXXXXXXXXXXXXXXXXXXXWXXHHP

SEQ ID NO: 108 - protein, 106 aa, Artificial Sequence; identical to SEQ ID NO: 107
  Description of Artificial Sequence: Synthetic polypeptide
  HA sequence element consensus sequence element
  MOD_RES (4)..(45): Any amino acid
  MISC_FEATURE (4)..(45): This region may encompass 27-42 residues
  MOD_RES (47)..(47): Ala or Thr
  MOD_RES (48)..(48): Ala or Ser
  MOD_RES (50)..(69): Any amino acid
  MISC_FEATURE (50)..(69): This region may encompass 5-20 residues
  MOD_RES (71)..(71): Ile or Leu
  MOD_RES (72)..(72): Thr or Val
  MOD_RES (73)..(100): Any amino acid
  MISC_FEATURE (73)..(100): This region may encompass 23-28 residues
  MOD_RES (102)..(103): Any amino acid
  See specification as filed for detailed description of substitutions and preferred embodiments

SEQ ID NO: 109 - protein, 10 aa, Artificial Sequence
  Description of Artificial Sequence: Synthetic peptide
  HA sequence element consensus sequence element
QLSSISSFEK

SEQ ID NO: 110 - protein, 106 aa, Artificial Sequence
  Description of Artificial Sequence: Synthetic polypeptide
  HA sequence element consensus sequence element
  MOD_RES (4)..(45): Any amino acid
  MISC_FEATURE (4)..(45): This region may encompass 27-42 residues
  MOD_RES (47)..(47): Ser or Asn
  MOD_RES (48)..(48): Ala or Ser
  MOD_RES (50)..(69): Any amino acid
  MISC_FEATURE (50)..(69): This region may encompass 5-20 residues
  MOD_RES (71)..(100): Any amino acid
  MISC_FEATURE (71)..(100): This region may encompass 25-30 residues
  MOD_RES (102)..(103): Any amino acid
  See specification as filed for detailed description of substitutions and preferred embodiments
CYPXXXXXXXXXXXXXXXXXXXXXXXXXXXXXXXXXXXXXXXXXXSXXCXXXXXXXXXXXXXXXXXXXXWXXXXXXXXXXXXXXXXXXXXXXXXXXXXXXWXXHHP

SEQ ID NO: 111 - protein, 106 aa, Artificial Sequence
  Description of Artificial Sequence: Synthetic polypeptide
  HA sequence element consensus sequence element
  MOD_RES (4)..(45): Any amino acid
  MISC_FEATURE (4)..(45): This region may encompass 27-42 residues
  MOD_RES (47)..(47): Ser or Asn
  MOD_RES (48)..(48): Ala or Ser
  MOD_RES (50)..(69): Any amino acid
  MISC_FEATURE (50)..(69): This region may encompass 5-20 residues
  MOD_RES (72)..(72): Thr or His
  MOD_RES (73)..(100): Any amino acid
  MISC_FEATURE (73)..(100): This region may encompass 23-28 residues
  MOD_RES (102)..(103): Any amino acid
  See specification as filed for detailed description of substitutions and preferred embodiments
CYPXXXXXXXXXXXXXXXXXXXXXXXXXXXXXXXXXXXXXXXXXXSXXCXXXXXXXXXXXXXXXXXXXXWLXXXXXXXXXXXXXXXXXXXXXXXXXXXXXWXXHHP

SEQ ID NO: 112 - protein, 10 aa, Artificial Sequence
  Description of Artificial Sequence: Synthetic peptide
  HA sequence element consensus sequence element
  MOD_RES (1)..(1): Leu or Ile
  MOD_RES (2)..(2): Val or Ile
XXASSGTLEF

SEQ ID NO: 113 - protein, 106 aa, Artificial Sequence
  Description of Artificial Sequence: Synthetic polypeptide
  HA sequence element consensus sequence element
  MOD_RES (4)..(45): Any amino acid
  MISC_FEATURE (4)..(45): This region may encompass 27-42 residues
  MOD_RES (50)..(69): Any amino acid
  MISC_FEATURE (50)..(69): This region may encompass 5-20 residues
  MOD_RES (71)..(100): Any amino acid
  MISC_FEATURE (71)..(100): This region may encompass 25-30 residues
  MOD_RES (102)..(103): Any amino acid
  See specification as filed for detailed description of substitutions and preferred embodiments
CYPXXXXXXXXXXXXXXXXXXXXXXXXXXXXXXXXXXXXXXXXXXSSACXXXXXXXXXXXXXXXXXXXXWXXXXXXXXXXXXXXXXXXXXXXXXXXXXXXWXXHHP

SEQ ID NO: 114 - protein, 106 aa, Artificial Sequence
  Description of Artificial Sequence: Synthetic polypeptide
  HA sequence element consensus sequence element
  MOD_RES (4)..(45): Any amino acid
  MISC_FEATURE (4)..(45): This region may encompass 27-42 residues
  MOD_RES (50)..(69): Any amino acid
  MISC_FEATURE (50)..(69): This region may encompass 5-20 residues
  MOD_RES (73)..(100): Any amino acid
  MISC_FEATURE (73)..(100): This region may encompass 23-28 residues
  MOD_RES (102)..(103): Any amino acid
  See specification as filed for detailed description of substitutions and preferred embodiments
CYPXXXXXXXXXXXXXXXXXXXXXXXXXXXXXXXXXXXXXXXXXXSSACXXXXXXXXXXXXXXXXXXXXWLIXXXXXXXXXXXXXXXXXXXXXXXXXXXXWXXHHP

SEQ ID NO: 115 - protein, 8 aa, Artificial Sequence
  Description of Artificial Sequence: Synthetic peptide
  HA sequence element consensus sequence element
  MOD_RES (6)..(7): Any amino acid
  MOD_RES (8)..(8): Lys or Arg
NDAAEXXX

SEQ ID NO: 116 - protein, 16 aa, Artificial Sequence
  Description of Artificial Sequence: Synthetic peptide
  HA sequence element consensus sequence element
  MOD_RES (8)..(8): Any amino acid
  MOD_RES (10)..(11): Any amino acid
  See specification as filed for detailed description of substitutions and preferred embodiments
YEELKHLXSXXNHFEK

SEQ ID NO: 117 - protein, 8 aa, Artificial Sequence
  Description of Artificial Sequence: Synthetic peptide
  HA sequence element consensus sequence element
GAIAGFIE

SEQ ID NO: 118 - protein, 23 aa, Artificial Sequence
  Description of Artificial Sequence: Synthetic peptide
  HA sequence element consensus sequence element
  MOD_RES (2)..(15): Any amino acid
  MISC_FEATURE (2)..(15): This region may encompass 4-14 residues
  See specification as filed for detailed description of substitutions and preferred embodiments
PXXXXXXXXXXXXXXGAIAGFIE

SEQ ID NO: 119 - protein, 17 aa, Artificial Sequence
  Description of Artificial Sequence: Synthetic peptide
  HA sequence element consensus sequence element
  MOD_RES (3)..(3): Ile or Val
  MOD_RES (7)..(9): Any amino acid
  See specification as filed for detailed description of substitutions and preferred embodiments
PSXQSRXXXGAIAGFIE

SEQ ID NO: 120 - protein, 17 aa, Artificial Sequence
  Description of Artificial Sequence: Synthetic peptide
  HA sequence element consensus sequence element
  MOD_RES (2)..(2): Any amino acid
  MOD_RES (4)..(4): Any amino acid
  MOD_RES (7)..(9): Any amino acid
  See specification as filed for detailed description of substitutions and preferred embodiments
PXKXTRXXXGAIAGFIE

SEQ ID NO: 121 - protein, 21 aa, Artificial Sequence
  Description of Artificial Sequence: Synthetic peptide
  HA sequence element consensus sequence element
  MOD_RES (4)..(6): Any amino acid
  MOD_RES (8)..(9): Any amino acid
  MOD_RES (11)..(13): Any amino acid
  See specification as filed for detailed description of substitutions and preferred embodiments
PQRXXXRXXRXXXGAIAGFIE

SEQ ID NO: 122 - protein, 567 aa, Artificial Sequence
  Description of Artificial Sequence: Synthetic polypeptide
  MOD_RES (203)..(203): Any naturally occurring amino acid
  MOD_RES (238)..(238): Any naturally occurring amino acid
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKRDNAYPTIKRSYNNTNQEDLLVLWGIHHPNDAAEQXRLYQNPTTYISVGTSTLNQRLVPKIATRSKVNGQXGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 123 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 124 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLNGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIAARSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 125 - protein, 567 aa, Artificial Sequence
  Description of Artificial Sequence: Synthetic polypeptide
  NCBI influenza virus sequence
  MOD_RES (197)..(197): Any naturally occurring amino acid
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRPSFFRNVVWLTKKDNAYPTIKRSYNNTNQEDLLVLWGIHHPXDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIGNLNKKMEDGFLDVWTYNAELLVLMENERTLDFHDSNVKNLYDKVRLQLRDNAKELGNGCFEFYHRCDNECMESVRNGTYDYPQYSEEARLKREEISGVKMESIGTYQILSIYSTVASSLALAIMVAGLFLWMCSNGSLQCRICI

SEQ ID NO: 126 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 127 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKRSYNNTNQEDLLVLWGIHHPNDAAEQTRLYQNPTTYISVGTSTLNQRLVPKITTRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 128 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 129 - protein, 567 aa, Artificial Sequence; identical to SEQ ID NO: 123
  Description of Artificial Sequence: Synthetic polypeptide
  NCBI influenza virus sequence

SEQ ID NO: 130 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGMSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 131 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLESRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 132 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKRSYNNTNQEDLLVLWGIHHPNDAEEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNALERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 133 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLIPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 134 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQNGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPHYSEEARLKREEISGVKLESIGTYQILSIYSTVASSLALAIMVAGLFLWMCSNGSLQCRICI

SEQ ID NO: 135 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPHYSEEARLKREEISGVKLESIGTYQILSIYSTVASSLALAIMVAGLFLWMCSNGSLQCRICI

SEQ ID NO: 136 - protein, 567 aa, Artificial Sequence
  Description of Artificial Sequence: Synthetic polypeptide
  NCBI influenza virus sequence
  MOD_RES (320)..(320): Any naturally occurring amino acid
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKXVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMMAGLFLWMCSNGSLQCRICI

SEQ ID NO: 137 - protein, 567 aa, Artificial Sequence; identical to SEQ ID NO: 123
  Description of Artificial Sequence: Synthetic polypeptide
  NCBI influenza virus sequence

SEQ ID NO: 138 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKRSYNNTNQEDLLVLWGIHHPNDATEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQEGRRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 139 - protein, 567 aa, Artificial Sequence; identical to SEQ ID NO: 132
  Description of Artificial Sequence: Synthetic polypeptide
  NCBI influenza virus sequence

SEQ ID NO: 140 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGSFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLILATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 141 - protein, 567 aa, Artificial Sequence; identical to SEQ ID NO: 123
  Description of Artificial Sequence: Synthetic polypeptide
  NCBI influenza virus sequence

SEQ ID NO: 142 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSSCPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFGSNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 143 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDATEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQEERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 144 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNSAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 145 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMERNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTQKDNAYPTIKRSYNNTNQEDLLVLWGIHHPNDAAEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 146 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIKIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKKSTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEAKLKREEISGVKLESIGTYQILSIYSTVASSLALAIMVAGLFLWMCSNGSLQCRICI

SEQ ID NO: 147 - protein, 567 aa, Artificial Sequence; identical to SEQ ID NO: 73
  Description of Artificial Sequence: Synthetic polypeptide
  NCBI influenza virus sequence

SEQ ID NO: 148 - protein, 567 aa, Artificial Sequence
  Description of Artificial Sequence: Synthetic polypeptide
  NCBI influenza virus sequence
MEKIVLLLAIVSLVESDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 149 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGKRRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 150 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVVSSLALAIMVAGLFLWMCSNGSLQCRICI

SEQ ID NO: 151 - protein, 567 aa, Artificial Sequence
  Description of Artificial Sequence: Synthetic polypeptide
  NCBI influenza virus sequence
MEKIVLLLAIVSVVKSDQICIGYHANYSTEQVDTIMEKDVIVTHAQDILEKTHNGKLCNLEGMKPLILRDCSVAGWLLGNPMCDEFHNVPEWSYIVEKINPANDLCYPGNFDDYEELQHLFSRINHFEKIQIIPKNCWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGKRRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKEFGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 152 - protein, 567 aa, Artificial Sequence
  Description of Artificial Sequence: Synthetic polypeptide
  NCBI influenza virus sequence
MEKIMLLLAIVSLVKGDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTKLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIVGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 153 - protein, 552 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLF

SEQ ID NO: 154 - protein, 567 aa, Artificial Sequence; identical to SEQ ID NO: 123
  Description of Artificial Sequence: Synthetic polypeptide
  NCBI influenza virus sequence

SEQ ID NO: 155 - protein, 567 aa, Artificial Sequence
  Description of Artificial Sequence: Synthetic polypeptide
  NCBI influenza virus sequence
  MOD_RES (199)..(199): Any naturally occurring amino acid
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHETSGVSSACPYQGRSSFFRNVVWLTKKDNAYPTIKRSYNNTNQEDLLVLWGIHHPNDXAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLFLWMCSNGSLQCRICI

SEQ ID NO: 156 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKAHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLILWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 157 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 158 - protein, 565 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 159 - protein, 565 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 160 - protein, 565 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKSNPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 161 - protein, 567 aa, Artificial Sequence
  Description of Artificial Sequence: Synthetic polypeptide
  NCBI influenza virus sequence
MKKIVLLLAIVTLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 162 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKSSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 163 - protein, 567 aa, Artificial Sequence; identical to SEQ ID NO: 128
  Description of Artificial Sequence: Synthetic polypeptide
  NCBI influenza virus sequence

SEQ ID NO: 164 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNSAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGIYQILSIYSTVASSLALAIMVAGLFLWMCSNGSLQCRICI

SEQ ID NO: 165 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKRSYNNTNQEDLLVLWGIHHPNDAAEQTRLYQNPTTYISVGTSTLNQRLVPKIATRSKVNEQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 166 - protein, 565 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 167 - protein, 565 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 168 - protein, 565 aa, Artificial Sequence
  Description of Artificial Sequence: Synthetic polypeptide
  NCBI influenza virus sequence
  MOD_RES (220)..(220): Any naturally occurring amino acid
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTXNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 169 - protein, 559 aa, Artificial Sequence
  Description of Artificial Sequence: Synthetic polypeptide
  NCBI influenza virus sequence
LLAIVSLVKSDQICIGYHANNSTEQVDTIMEKNVTVTHAQDILEKTHNGKLCNLDGVKPLILRDCSVAGWLLGNPMCDEFLNVPEWSYIVEKINPVNDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILRSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 170 - protein, 565 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDDAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 171 - protein, 565 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWITKKDNAYPTIRRSYNNTNQEDLLVLWGIHHPNDAAEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 172 - protein, 565 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGISSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPITIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 173 - protein, 553 aa, Artificial Sequence
  Description of Artificial Sequence: Synthetic polypeptide
  NCBI influenza virus sequence
LVKSDQICVGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLVTGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 174 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDATEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 175 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDATEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVTSSLALAIMVAGLFLWMCSNGSLQCRICI

SEQ ID NO: 176 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGIFLWMCSNGSLQCRICI

SEQ ID NO: 177 - protein, 553 aa, Artificial Sequence
  Description of Artificial Sequence: Synthetic polypeptide
  NCBI influenza virus sequence
KSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNYWSDHEASGVSSACPYQGRSSFFRNVVWLTKKNNAYPTIKRSYNNTNQEDLLVLWGIHHPNDAEEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNALERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 178 - protein, 565 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKRSYNNTNQEDLLVLWGIHHPNDAAEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVRLESIGTYQILSIYSTVASSLALAIMVAGLFLWMCSNGSLQCRI

SEQ ID NO: 179 - protein, 565 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDATEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQEERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRI

SEQ ID NO: 180 - protein, 561 aa, Artificial Sequence
  Description of Artificial Sequence: Synthetic polypeptide
  NCBI influenza virus sequence
LLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNGPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 181 - protein, 567 aa, Artificial Sequence
  Description of Artificial Sequence: Synthetic polypeptide
  NCBI influenza virus sequence
MEKMVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNGPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 182 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNSAYPTIKKSYNNTNQEDLLVLWGIHHPNDAEEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNALERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 183 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLNGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAAEQTKLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 184 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDATEQTRLYQNPTTYISVGTSTLNQRLVPKIATRSKVNGQSGRMEFFWTILKSNDAINFDSNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 185 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAAEQTRLYQNPTTYISVGTSTLNQRLVPKIATRPKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 186 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAAEQTRLYQNPTTYISVGTSTLNQRLVPKIANRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 187 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 188 - protein, 557 aa, Artificial Sequence
  Description of Artificial Sequence: Synthetic polypeptide
  NCBI influenza virus sequence
VSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDATEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGDRRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 189 - protein, 567 aa, Artificial Sequence
  Description of Artificial Sequence: Synthetic polypeptide
  NCBI influenza virus sequence
MEKIVLLLAIFSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 190 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPTNDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 191 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDATEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGDRRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 192 - protein, 567 aa, Artificial Sequence
  Description of Artificial Sequence: Synthetic polypeptide
  NCBI influenza virus sequence
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHGASGVSSACPYQGRSSFFRNVVWLTKKDNAYPTIKKSYNNTNQEDLLILWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 193 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAVEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLVLAIIVAGLFLWMCSNGSLQCRICI

SEQ ID NO: 194 - protein, 567 aa, Artificial Sequence
  Description of Artificial Sequence: Synthetic polypeptide
  NCBI influenza virus sequence
MEKIVLLLAIFSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYLTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 195 - protein, 558 aa, Artificial Sequence
  Description of Artificial Sequence: Synthetic polypeptide
  NCBI influenza virus sequence
IVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKDSWSDHEASGVSSACPYQGRSSFFRNVVWLTKRNNAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 196 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKDSWSDHEASGVSSACPYQGRSSFFRNVVWLTKKNNAYPTIKKNYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 197 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPSNDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDEAEQTRLYQNPTTYISVGTSTLNQRLVPKIATRSKVNGQSGRMEFFWTILKSNDAINFESNGNFIVPENAYKIVKKGDSTIMKSELEYGSCNTKCQTPIGAINSSMPFHNIHPLTIGECPKYVKSNRLVLATGLRNSPQGERKRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 198 - protein, 567 aa, Artificial Sequence
  Description of Artificial Sequence: Synthetic polypeptide
  NCBI influenza virus sequence
MEKIVLLLAIISIVKSDQICIGYHANNSTEQVDTIMEKNVTVTHAQDILEKTHNGKLCSLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 199 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 200 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIISKNSWSDHEASGVSSACPYQGRSSFFRNVVWLTKKNNAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVVSSLALAIMVAGLFLWMCSNGSLQCRICI

SEQ ID NO: 201 - protein, 567 aa, Artificial Sequence
  Description of Artificial Sequence: Synthetic polypeptide
  NCBI influenza virus sequence
MEKIVLLLAIFSLVKSDQICIGYHANNSTEQVDTIMEKNVTVTHAQDILEKTHNGKLCNLDGVKPLILRNCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 202 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLNGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 203 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDEAEQTRLYQNSTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLKDNAKELGNGCFEFYHRCDNECMESVRNGTYDYPQYSEEARLKREEISGVKLESIGTYQILSIYSTVTSSLALAIMVAGLFLWMCSNGSLQCRICI

SEQ ID NO: 204 - protein, 567 aa, Artificial Sequence
  Description of Artificial Sequence: Synthetic polypeptide
  NCBI influenza virus sequence
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNDAYPTIKKSYNNTNQEDLLVIWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGEKRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLVLAIMVAGLFLWMCSNGSLQCRICI

SEQ ID NO: 205 - protein, 568 aa, Artificial Sequence; identical to SEQ ID NO: 50
  Description of Artificial Sequence: Synthetic polypeptide
  NCBI influenza virus sequence

SEQ ID NO: 206 - protein, 568 aa, Artificial Sequence; identical to SEQ ID NO: 51
  Description of Artificial Sequence: Synthetic polypeptide
  NCBI influenza virus sequence

SEQ ID NO: 207 - protein, 6 aa, Artificial Sequence
  Description of Artificial Sequence: Synthetic 6xHis tag
HHHHHH

SEQ ID NO: 208 - protein, 111 aa, Artificial Sequence
  Description of Artificial Sequence: Synthetic polypeptide
ENGTCYPGEFIDYEELREQLSSISSFEKFEIFPKASSWPNHETTKGVTAACSYSGASSFYRNLIWITKKGTSYPKLSKSYTNNKGKEVLVIWGVHHPPSVSEQQSLYQNAD

SEQ ID NO: 209 - protein, 111 aa, Artificial Sequence
  Description of Artificial Sequence: Synthetic polypeptide
ENGTCYPGDFIDYEELREQLSSVSSFEKFEIFPKTSSWPNHETTKGVTAACSYAGASSFYRNLIWLTKKGSSYPKLSKSYVNNKGKEVLVIWGVHHPPTGTDQQSLYQNAD

SEQ ID NO: 210 - protein, 110 aa, Artificial Sequence
  Description of Artificial Sequence: Synthetic polypeptide
ENGTCYPGYFADYEELREQLSSVSSFERFEIFPKESSWPNHTVTGVSASCSHNGKSSFYRNLIWLTGKNGLYPNLSKSYVNNKEKEVLVIWGVHHPPNIGDQRALYHTEN

SEQ ID NO: 211 - protein, 109 aa, Artificial Sequence
  Description of Artificial Sequence: Synthetic polypeptide
ANGLCYPGSFNDYEELKHLLTSVTHFEKVKILPRDQWTQHTTTGGSRACAVSGNPSFFRNMVWLTEKGSNYPIAKRSYNNTSGKQMLVIWGIHHPNDDTEQRTLYQNVG

SEQ ID NO: 212 - protein, 109 aa, Artificial Sequence
  Description of Artificial Sequence: Synthetic polypeptide
RDGLCYPGSFNDYEELKHLLSSVKHFEKVKILPKDRWTQHTTTGGSRACAVSGNPSFFRNMVWLTEKGSNYPVAKGSYNNTSGEQMLIIWGVHHPNDEKEQRTLYQNVG

SEQ ID NO: 213 - protein, 106 aa, Artificial Sequence
  Description of Artificial Sequence: Synthetic polypeptide
FSNCYPYDIPDYASLRSLVASSGTLEFITEGFTWTGVTQNGGSSACKRGPANGFFSRLNWLTKSESAYPVLNVTMPNNDNFDKLYIWGVHHPSTNQEQTDLYVQAS

SEQ ID NO: 214 - protein, 106 aa, Artificial Sequence
  Description of Artificial Sequence: Synthetic polypeptide
FSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQAS

SEQ ID NO: 215 - protein, 106 aa, Artificial Sequence
  Description of Artificial Sequence: Synthetic polypeptide
YSNCYPYDVPDYASLRSLVASSGTLEFNNESFNWAGVTQNGTSSACKRRSNKSFFSRLNWLTHLKYKYPALNVTMPNNEKFDKLYIWGVHHPVTDSDQISLYAQAS

SEQ ID NO: 216 - protein, 107 aa, Artificial Sequence
  Description of Artificial Sequence: Synthetic polypeptide
VDTCYPFDVPDYQSLRSILANNGKFEFIAEEFQWNTVKQNGKSGACKRANVNDFFNRLNWLTKSNGDAYPLQNLTKVNNGDYARLYIWGVHHPSTDTEQTDLYKNNP

SEQ ID NO: 217 - protein, 110 aa, Artificial Sequence
  Description of Artificial Sequence: Synthetic polypeptide
VNDLCYPGDFNDYEELKHLLSRINHFEKIQIIPKSSWSSHEASLGVSSAVPYQGKSSFFRNVVWLIKKNSTYPTIKRSYNNTNQEDLLVIWGIHHPNDAAEQTKLYQNPT

SEQ ID NO: 218 - protein, 110 aa, Artificial Sequence
  Description of Artificial Sequence: Synthetic polypeptide
ANDLCYPGDFNDYEELKHLLSRINHFEKIQIIPKNSWSSHEASLGVSSACPYQGKSSFFRNVVWLIKKNNAYPTIKRSYNNTNQEDLLVIWGIHHPNDAAEQTRLYQNPT

SEQ ID NO: 219 - protein, 111 aa, Artificial Sequence
  Description of Artificial Sequence: Synthetic polypeptide
QNGICYPGTLNEIEELKALIGSGERIERFEMFPKSTWSGVNTNNGVTRACPDNSGSSFYRNLIWITKTNSAAYPVIKGTYNNTGNQPILYFWGVHHPPDTNAQNNLYGSGD

SEQ ID NO: 220 - protein, 107 aa, Artificial Sequence
  Description of Artificial Sequence: Synthetic polypeptide
SDVCYPGKFVNEEALRQILRESGGINKETMGFTYSGIRTNGATSTCRRSGSSFYAEMKWLLSNTDNAAFPQMTKSYKNTRKDPALIIWGIHHSGSTTEQTKLYGSGN

SEQ ID NO: 221 - protein, 110 aa, Artificial Sequence
  Description of Artificial Sequence: Synthetic polypeptide
PEGMCYPGSVENLEELRFVFSSAASYKRIRLFDYSRWNVTRSGTSKACNASTGGQSFYRSINWLTKKKPDTYDFNEGAYVNNEDGDIIFLWGIHHPPDTKEQTTLYKNAN

SEQ ID NO: 222 - protein, 104 aa, Artificial Sequence
  Description of Artificial Sequence: Synthetic polypeptide
VNGTCYPGNVENLEELRTLFSSASSYQRIQIFPDTIWNVTYTGTSKACSGSFYRSMRWLTQKSGSYPVQDAQYTNNREKSILFVWGIHHPPTDTAQTNLYINTD

SEQ ID NO: 223 - protein, 109 aa, Artificial Sequence
  Description of Artificial Sequence: Synthetic polypeptide
IAYCYPGATVNEEALRQKIMESGGIDKISTGFTYGSSINSAGTTRSCMRSGGNSFYAELKWLVSKNKGQNFPQTANTYRNTDSAEHLIIWGIHHPSSTQEKNDLYGTQS

SEQ ID NO: 224 - protein, 110 aa, Artificial Sequence
  Description of Artificial Sequence: Synthetic polypeptide
TNGICYPGTLENEEELRLKFSGVLEFSKFEAFTSNGWGAVNSGAGVTAACKFGSSNSFFRNMIWLIHQSGTYPVIRRTFNNTKGRDVLVVWGVHHPATLKEHQDLYKKDS

SEQ ID NO: 225 - protein, 109 aa, Artificial Sequence
  Description of Artificial Sequence: Synthetic polypeptide
MEGVCYPGSIENQEELRSLFSSIKKYERVKMFDFTKWNVTYTGTSRACNNTSNRGSFYRSMRWLTLKSGQFPVQTDEYKNTRDSDILFTWAIHHPPTSAEQVQLYKNPD

SEQ ID NO: 226 - protein, 109 aa, Artificial Sequence
  Description of Artificial Sequence: Synthetic polypeptide
PHGICYPGELNNNGELRHLFSGIRSFSRTELIPPTSWGEVLDGATSACRDDKGTNSFYRNLVWFVKKNNRYPVISKTYNNTTGRDVLVIWGIHHPVSVEETKTLYVNSD

SEQ ID NO: 227 - protein, 107 aa, Artificial Sequence
  Description of Artificial Sequence: Synthetic polypeptide
VDTCYPFDVPDYQSLRSILASSGSLEFIAEQFTWNGVKVDGSSSACLRGGRNSFFSRLNWLTKETNGNYGPINVTKENTGSYVRLYIWGVHHPSSDNEQTDLYKVAT

SEQ ID NO: 228 - protein, 107 aa, Artificial Sequence
  Description of Artificial Sequence: Synthetic polypeptide
SDICYPGKFTNEEALRQIIRESGGIDKEPMGFRYSGIKTDGATSACKRTVSSFYSEMKWLLSSKANQVFPQLNQTYRNNRKEPALIVWGVHHSSSLDEQNKLYGAGN

SEQ ID NO: 229 - protein, 109 aa, Artificial Sequence
  Description of Artificial Sequence: Synthetic polypeptide
PNKICFPGELDNNGELRHLFSGVNSFSRTELISPNKWGDILDGVTASCRDNGASSFYRNLVWIVKNKNGKYPVIKGDYNNTTGRDVLVIWGIHHPDTETTAINLYASKN

SEQ ID NO: 230 - protein, 109 aa, Artificial Sequence
  Description of Artificial Sequence: Synthetic polypeptide
IGECPKYVKSTKLRMATGLRNVPSIQSRGLFGAIAGFIEGGWTGMIDGWYGYHHQNEQGSGYAADQKSTQNAIDGITSKVNSVIEKMNTQFTAVGKEFNNLERRIENLN

SEQ ID NO: 231 - protein, 109 aa, Artificial Sequence
  Description of Artificial Sequence: Synthetic polypeptide
IGECPKYVRSTKLRMATGLRNIPSIQSRGLFGAIAGFIEGGWTGMIDGWYGYHHQNEQGSGYAADQKSTQNAIDGITNKVNSVIEKMNTQFTAVGKEFNNLERRIENLN

SEQ ID NO: 232 - protein, 109 aa, Artificial Sequence
  Description of Artificial Sequence: Synthetic polypeptide
IGECPKYVRSAKLRMVTGLRNIPSIQSRGLFGAIAGFIEGGWTGMVDGWYGYHHQNEQGSGYAADQKSTQNAINGITNKVNSNIEKMNTQFTAVGKEFNKLERRMENLN

SEQ ID NO: 233 - protein, 109 aa, Artificial Sequence
  Description of Artificial Sequence: Synthetic polypeptide
IGECPKYVKSDRLVLATGLRNVPQIESRGLFGAIAGFIEGGWQGMVDGWYGYHHSNDQGSGYAADKESTQKAIDGITNKVKSVIEKMNTQFEAVGKEFNNLERRLENLN

SEQ ID NO: 234 - protein, 109 aa, Artificial Sequence
  Description of Artificial Sequence: Synthetic polypeptide
IGECPKYVKSEKLVLATGLRNVPQIESRGLFGAIAGFIEGGWQGMIDGWYGYHHSNDQGSGYAADKESTQKAFDGITNKVNSVIEKMNTQFEAVGKEFSNLERRLENLN

SEQ ID NO: 235 - protein, 109 aa, Artificial Sequence
  Description of Artificial Sequence: Synthetic polypeptide
YGACPKYVKQNTLKLATGMRNVPGKQTRGLFGAIAGFIENGWEGMIDGWYGFRHQNSEGTGQAADLKSTQAAIDQINRKLNRVIEKTNEKFHQIEKEFSEVEGRIQDLE

SEQ ID NO: 236 - protein, 109 aa, Artificial Sequence
  Description of Artificial Sequence: Synthetic polypeptide
YGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLE

SEQ ID NO: 237 - protein, 109 aa, Artificial Sequence
  Description of Artificial Sequence: Synthetic polypeptide
YGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLE

SEQ ID NO: 238 - protein, 109 aa, Artificial Sequence
  Description of Artificial Sequence: Synthetic polypeptide
IGDCPKYVKQGSLKLATGMRNIPEKQTRGLFGAIAGFIENGWQGLIDGWYGFRHQNAEGTGTAADLKSTQAAIDQINGKLNRLIEKTNEKYHQIEKEFEQVEGRIQDLE

SEQ ID NO: 239 - protein, 113 aa, Artificial Sequence
  Description of Artificial Sequence: Synthetic polypeptide
IGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLN

SEQ ID NO: 240 - protein, 113 aa, Artificial Sequence
  Description of Artificial Sequence: Synthetic polypeptide
IGECPKYVKSNRLVLATGLRNSPQRERRRKKRGLFGAIAGFIEGGWQGMVDGWYGYHHSNEQGSGYAADKESTQKAIDGVTNKVNSIIDKNMTQFEAVGREFNNLERRIENLN

SEQ ID NO: 241 - protein, 109 aa, Artificial Sequence
  Description of Artificial Sequence: Synthetic polypeptide
IGKCPKYVKSESLRLATGLRNVPQIATRGLFGAIAGFIEGGWTGLVDGWYGYHHENSQGSGYAADRESTQKAIDGITNKVNSIIDKMNTQFEAVDHEFSNLERRIDNMN

SEQ ID NO: 242 - protein, 110 aa, Artificial Sequence
  Description of Artificial Sequence: Synthetic polypeptide
VGKCPRYVKQESLMLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVI

SEQ ID NO: 243 - protein, 109 aa, Artificial Sequence
  Description of Artificial Sequence: Synthetic polypeptide
MGECPKYVKKASLRLAVGLRNTPSVEPRGLFGAIAGFIEGGWSGMIDGWYGFHHSNSEGTGMAADQKSTQEAIDKITNKVNNIVDKMNREFEVVNHEFSEVEKRINMIN

SEQ ID NO: 244 - protein, 109 aa, Artificial Sequence
  Description of Artificial Sequence: Synthetic polypeptide
FGICPKYVRVKSLKLAVGLRNVPARSNRGLFGAIAGFIEGGWPGLVAGWYGFQHSNDQGVGMAADRDSTQRAIDKITSKVNNIVDKMNKQYEIIDHEFSEVETRLNMIN

SEQ ID NO: 245 - protein, 110 aa, Artificial Sequence
  Description of Artificial Sequence: Synthetic polypeptide
VGQCPKYVNKKSLLLATGMRNVPEVVQGRGLFGAIAGFIENGWEGMVDGWYGFRHQNAQGTGQAADYKSTQAAIDQITGKLNRLIEKTNTEFESIESEFSEIEHQIGNVI

SEQ ID NO: 246 - protein, 109 aa, Artificial Sequence
  Description of Artificial Sequence: Synthetic polypeptide
IGDCPKYVNVKSLKLATGLRNVPAIATRGLFGAIAGFIEGGWPGLINGWYGFQHRNEEGTGIAADKESTQKAIDQITSKVNNIVDRMNTNFESVQHEFSEIEERINQLS

SEQ ID NO: 247 - protein, 109 aa, Artificial Sequence
  Description of Artificial Sequence: Synthetic polypeptide
IGKCPKYIPSGSLKLAIGLRNVPQVQNRGLFGAIAGFIEGGWPGLVAGWYGFQHQNAEGTGMAADRDSTQKAIDNMQNKLNNVIDKMNKQFEVVNHEFSEVESRINMIN

SEQ ID NO: 248 - protein, 109 aa, Artificial Sequence
  Description of Artificial Sequence: Synthetic polypeptide
LGDCPKYIKSGQLKLATGLRNVPAISNRGLLGAIAGFIEGGWPGLINGWYGFQHQNEQGTGIAADKESTQKAIDQITTKINNIIDKMNGNYDSIRGEFNQVEKRINMLA

SEQ ID NO: 249 - protein, 109 aa, Artificial Sequence
  Description of Artificial Sequence: Synthetic polypeptide
IGNCPKYVKQGSLMLATGMRNIPGKQAKGLFGAIAGFIENGWQGLIDGWYGFRHQNAEGTGTAADLKSTQAAIDQINGKLNRLIEKTNEKYHQIEKEFEQVEGRIQDLE

SEQ ID NO: 250 - protein, 110 aa, Artificial Sequence
  Description of Artificial Sequence: Synthetic polypeptide
VGRCPRYVKQSSLPLALGMKNVPEKIHTRGLFGAIAGFIENGWEGLIDGWYGFRHQNAQGQGTAADYKSTQAAIDQITGKLNRLIEKTNTQFELIDNEFTEVEQQIGNVI

SEQ ID NO: 251 - protein, 109 aa, Artificial Sequence
  Description of Artificial Sequence: Synthetic polypeptide
LGDCPKYIKSGQLKLATGLRNVPSVGERGLFGAIAGFIEGGWPGLINGWYGFQHQNEQGTGIAADKASTQKAIDEITTKINNIIEKMNGNYDSIRGEFNQVEKRINMLA

SEQ ID NO: 252 - protein, 111 aa, Artificial Sequence
  Description of Artificial Sequence: Synthetic polypeptide
ENGTCYPGEFIDYEELREQLSSISSFEKFEIFPKASSWPNHETTKGVTAACSYSGASSFYRNLLWITKKGTSYPKLSKSYTNNKGKEVLVIWGVHHPPSVSEQQSLYQNAD

SEQ ID NO: 253 - protein, 111 aa, Artificial Sequence
  Description of Artificial Sequence: Synthetic polypeptide
ENGTCYPGDFIDYEELREQLSSVSSFEKFEIFPKTSSWPNHETTKGVTAACSYAGASSFYRNLLWLTKKGSSYPKLSKSYVNNKGKEVLVIWGVHHPPTGTDQQSLYQNAD

SEQ ID NO: 254 - protein, 110 aa, Artificial Sequence
  Description of Artificial Sequence: Synthetic polypeptide
ENGTCYPGYFADYEELREQLSSVSSFERFEIFPKESSWPNHTVTGVSASCSHNGKSSFYRNLLWLTKKGGLYPKLSKSYVNNKEKEVLVIWGVHHPPNIGDQRALYHTEN

SEQ ID NO: 255 - protein, 109 aa, Artificial Sequence
  Description of Artificial Sequence: Synthetic polypeptide
ANGICYPGSFNDYEELKHLLTSVTHFEKVKILPRDQWTQHTTTGGSRACAVSGNPSFFRNMVWLTEKGSNYPIAKRSYNNTSGKQMLVIWGIHHPNDDTEQRTLYQNVG

SEQ ID NO: 256 - protein, 109 aa, Artificial Sequence
  Description of Artificial Sequence: Synthetic polypeptide
RDGICYPGSFNDYEELKHLLSSVKHFEKVKILPRDQWTQHTTTGGSRACAVSGNPSFFRNMVWLTEKGSNYPVAKGSYNNTSGEQMLIIWGVHHPNDDKEQRTLYQNVG

SEQ ID NO: 257 - protein, 106 aa, Artificial Sequence
  Description of Artificial Sequence: Synthetic polypeptide
FSNCYPYDIPDYASLRSLVASSGTLEFITEGFTWTGYTQNGGSSACKRGPANGFFSRLNWLTKSESAYPVLNVTMPNNDNFDKLYIWGVHHPSTNQEQTDLYVQAS

SEQ ID NO: 258 - protein, 106 aa, Artificial Sequence
  Description of Artificial Sequence: Synthetic polypeptide
FSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQAS

SEQ ID NO: 259 - protein, 106 aa, Artificial Sequence
  Description of Artificial Sequence: Synthetic polypeptide
YSNCYPYDVPDYASLRSLVASSGTLEFNNESFNWAGVTQNGGSSACKRRSNKSFFSRLNWLTHLKYKYPALNVTMPNNEKFDKLYIWGVHHPVTDSDQISLYAQAS

SEQ ID NO: 260 - protein, 107 aa, Artificial Sequence
  Description of Artificial Sequence: Synthetic polypeptide
VDTCYPFDVPDYQSLRSILANNGRFEFIAEEFQWNTVKQNGKSGACKRANVNDFFNRLNWLTKSNGDAYPLQNLTKVNNGDYARLYIWGVHHPSTDTEQTDLYKNNP

SEQ ID NO: 261 - protein, 110 aa, Artificial Sequence
  Description of Artificial Sequence: Synthetic polypeptide
VNDLCYPGDFNDYEELKHLLSRINHFEKIQIIPKSSWSSHEASLGVSSACPYQGKSSFFRNVVWLIKKNSTYPTIKRSYNNTNQEDLLVIWGIHHPNDAAEQTKLYQNPT

SEQ ID NO: 262 - protein, 110 aa, Artificial Sequence; identical to SEQ ID NO: 218
  Description of Artificial Sequence: Synthetic polypeptide

SEQ ID NO: 263 - protein, 111 aa, Artificial Sequence
  Description of Artificial Sequence: Synthetic polypeptide
QNGICYPGTLNEIEELKALIGSGERIERFEMFPKSTWSGVNTNNGVTRACPDNSGSSFYRNLLWITKTNSAAYPVIKGTYNNTGNQPILYFWGVHHPPDTNAQNNLYGSGD

SEQ ID NO: 264 - protein, 107 aa, Artificial Sequence; identical to SEQ ID NO: 220
  Description of Artificial Sequence: Synthetic polypeptide

SEQ ID NO: 265 - protein, 110 aa, Artificial Sequence; identical to SEQ ID NO: 221
  Description of Artificial Sequence: Synthetic polypeptide

SEQ ID NO: 266 - protein, 104 aa, Artificial Sequence; identical to SEQ ID NO: 222
  Description of Artificial Sequence: Synthetic polypeptide

SEQ ID NO: 267 - protein, 109 aa, Artificial Sequence; identical to SEQ ID NO: 223
  Description of Artificial Sequence: Synthetic polypeptide

SEQ ID NO: 268 - protein, 110 aa, Artificial Sequence
  Description of Artificial Sequence: Synthetic polypeptide
TNGICYPGTLENEEELRNKFSGVLEFSKFEAFTSNGWGAVNSGAGVTAACKFGSSNSFFRNMIWLIHQSGTYPVIRRTFNNTKGRDVLVVWGVHHPATLKEHQDLYKKDS

SEQ ID NO: 269 - protein, 109 aa, Artificial Sequence; identical to SEQ ID NO: 225
  Description of Artificial Sequence: Synthetic polypeptide

SEQ ID NO: 270 - protein, 109 aa, Artificial Sequence
  Description of Artificial Sequence: Synthetic polypeptide
PHGLCYPGELNNNGELRHLFSGITSGSRTELIPPTSWGEVLDGATSACRDDKGTNSFYRNLVWFVKKNNRYPVISKTYNNTTGRDVLVLWGIHHPVSVEETKTLYVNSD

SEQ ID NO: 271 - protein, 107 aa, Artificial Sequence
  Description of Artificial Sequence: Synthetic polypeptide
VDTCYPFDVPDYQSLRSILASSGSLEFIAEQFTWNGVKVDGSSSACLRGGRNSFFSRLNWLTKETNGNYGPINVTKENTGSYVRLYLWGVHHPSSDNEQTDLYKVAT

SEQ ID NO: 272 - protein, 107 aa, Artificial Sequence; identical to SEQ ID NO: 228
  Description of Artificial Sequence: Synthetic polypeptide

SEQ ID NO: 273 - protein, 109 aa, Artificial Sequence
  Description of Artificial Sequence: Synthetic polypeptide
PNKICFPGELDNNGELRHLFSGVNSFSRTELISPNKWGDILDGVTASCRDNGASSFYRNLVWIVKNKNGKYPVIKGDYNNTTGRDVLVLWGIHHPDTETTAINLYASKN

SEQ ID NO: 274 - protein, 109 aa, Artificial Sequence; identical to SEQ ID NO: 230
  Description of Artificial Sequence: Synthetic polypeptide

SEQ ID NO: 275 - protein, 109 aa, Artificial Sequence; identical to SEQ ID NO: 231
  Description of Artificial Sequence: Synthetic polypeptide

SEQ ID NO: 276 - protein, 109 aa, Artificial Sequence; identical to SEQ ID NO: 232
  Description of Artificial Sequence: Synthetic polypeptide

SEQ ID NO: 277 - protein, 109 aa, Artificial Sequence
  Description of Artificial Sequence: Synthetic polypeptide
IGECPKYVKSDRLVLATGLRNVPQIESRGLFGAIAGFIEGGWQGMVDGWYGYHHSNDQGSGYAADKESTQKAIDGITNKVNSVIEKMNTQFEAVGKEFNNLERRLENLN

SEQ ID NO: 278 - protein, 109 aa, Artificial Sequence; identical to SEQ ID NO: 234
  Description of Artificial Sequence: Synthetic polypeptide

SEQ ID NO: 279 - protein, 109 aa, Artificial Sequence; identical to SEQ ID NO: 235
  Description of Artificial Sequence: Synthetic polypeptide

SEQ ID NO: 280 - protein, 109 aa, Artificial Sequence; identical to SEQ ID NO: 236
  Description of Artificial Sequence: Synthetic polypeptide

SEQ ID NO: 281 - protein, 109 aa, Artificial Sequence; identical to SEQ ID NO: 237
  Description of Artificial Sequence: Synthetic polypeptide

SEQ ID NO: 282 - protein, 109 aa, Artificial Sequence
  Description of Artificial Sequence: Synthetic polypeptide
IGDCPKYVKQGSLKLATGMRNIPEKQTRGIFGAIAGFIENGWQGLIDGWYGFRHQNAEGTGTAADLKSTQAAIDQINGKLNRLIEKTNEKYHQIEKEFEQVEGRIQDLE

SEQ ID NO: 283 - protein, 113 aa, Artificial Sequence; identical to SEQ ID NO: 239
  Description of Artificial Sequence: Synthetic polypeptide

SEQ ID NO: 284 - protein, 113 aa, Artificial Sequence; identical to SEQ ID NO: 240
  Description of Artificial Sequence: Synthetic polypeptide

SEQ ID NO: 285 - protein, 109 aa, Artificial Sequence; identical to SEQ ID NO: 241
  Description of Artificial Sequence: Synthetic polypeptide

SEQ ID NO: 286 - protein, 110 aa, Artificial Sequence; identical to SEQ ID NO: 242
  Description of Artificial Sequence: Synthetic polypeptide

SEQ ID NO: 287 - protein, 109 aa, Artificial Sequence
  Description of Artificial Sequence: Synthetic polypeptide
MGECPKYVKKASLRLAVGLRNTPSVEPRGLFGAIAGFIEGGWSGMIDGWYGFHHSNSEGTGMAADQKSTQEAIDKITNKVNNIVDKMNREFEYVNHEFSEVEKRINMIN

SEQ ID NO: 288 - protein, 109 aa, Artificial Sequence; identical to SEQ ID NO: 244
  Description of Artificial Sequence: Synthetic polypeptide

SEQ ID NO: 289 - protein, 110 aa, Artificial Sequence; identical to SEQ ID NO: 245
  Description of Artificial Sequence: Synthetic polypeptide

SEQ ID NO: 290 - protein, 109 aa, Artificial Sequence; identical to SEQ ID NO: 246
  Description of Artificial Sequence: Synthetic polypeptide

SEQ ID NO: 291 - protein, 109 aa, Artificial Sequence; identical to SEQ ID NO: 247
  Description of Artificial Sequence: Synthetic polypeptide

SEQ ID NO: 292 - protein, 109 aa, Artificial Sequence; identical to SEQ ID NO: 248
  Description of Artificial Sequence: Synthetic polypeptide

SEQ ID NO: 293 - protein, 109 aa, Artificial Sequence; identical to SEQ ID NO: 249
  Description of Artificial Sequence: Synthetic polypeptide

SEQ ID NO: 294 - protein, 110 aa, Artificial Sequence; identical to SEQ ID NO: 250
  Description of Artificial Sequence: Synthetic polypeptide

SEQ ID NO: 295 - protein, 109 aa, Artificial Sequence; identical to SEQ ID NO: 251
  Description of Artificial Sequence: Synthetic polypeptide

SEQ ID NO: 296 - protein, 111 aa, Artificial Sequence; identical to SEQ ID NO: 252
  Description of Artificial Sequence: Synthetic polypeptide

SEQ ID NO: 297 - protein, 111 aa, Artificial Sequence; identical to SEQ ID NO: 253
  Description of Artificial Sequence: Synthetic polypeptide

SEQ ID NO: 298 - protein, 110 aa, Artificial Sequence; identical to SEQ ID NO: 254
  Description of Artificial Sequence: Synthetic polypeptide

SEQ ID NO: 299 - protein, 109 aa, Artificial Sequence; identical to SEQ ID NO: 255
  Description of Artificial Sequence: Synthetic polypeptide

SEQ ID NO: 300 - protein, 109 aa, Artificial Sequence; identical to SEQ ID NO: 256
  Description of Artificial Sequence: Synthetic polypeptide

SEQ ID NO: 301 - protein, 106 aa, Artificial Sequence; identical to SEQ ID NO: 213
  Description of Artificial Sequence: Synthetic polypeptide

SEQ ID NO: 302 - protein, 106 aa, Artificial Sequence; identical to SEQ ID NO: 258
  Description of Artificial Sequence: Synthetic polypeptide

SEQ ID NO: 303 - protein, 106 aa, Artificial Sequence; identical to SEQ ID NO: 259
  Description of Artificial Sequence: Synthetic polypeptide

SEQ ID NO: 304 - protein, 107 aa, Artificial Sequence; identical to SEQ ID NO: 216
  Description of Artificial Sequence: Synthetic polypeptide

SEQ ID NO: 305 - protein, 110 aa, Artificial Sequence; identical to SEQ ID NO: 261
  Description of Artificial Sequence: Synthetic polypeptide

SEQ ID NO: 306 - protein, 110 aa, Artificial Sequence; identical to SEQ ID NO: 218
  Description of Artificial Sequence: Synthetic polypeptide

SEQ ID NO: 307 - protein, 111 aa, Artificial Sequence; identical to SEQ ID NO: 263
  Description of Artificial Sequence: Synthetic polypeptide

SEQ ID NO: 308 - protein, 107 aa, Artificial Sequence; identical to SEQ ID NO: 220
  Description of Artificial Sequence: Synthetic polypeptide

SEQ ID NO: 309 - protein, 110 aa, Artificial Sequence
  Description of Artificial Sequence: Synthetic polypeptide
PEGMCYPGSVENLEELRFVFSSAASYKRIRLFDYSRWNVTRSGTSKACNASTGGQSFYRSINWLTKKKPDTYDFNEGAYVNNEDGDIIFIWGIHHPPDTKEQTTLYKNAN

SEQ ID NO: 310 - protein, 104 aa, Artificial Sequence; identical to SEQ ID NO: 222
  Description of Artificial Sequence: Synthetic polypeptide

SEQ ID NO: 311 - protein, 109 aa, Artificial Sequence; identical to SEQ ID NO: 223
  Description of Artificial Sequence: Synthetic polypeptide

SEQ ID NO: 312 - protein, 110 aa, Artificial Sequence; identical to SEQ ID NO: 268
  Description of Artificial Sequence: Synthetic polypeptide

SEQ ID NO: 313 - protein, 109 aa, Artificial Sequence; identical to SEQ ID NO: 225
  Description of Artificial Sequence: Synthetic polypeptide

SEQ ID NO: 314 - protein, 109 aa, Artificial Sequence
  Description of Artificial Sequence: Synthetic polypeptide
PHGLCYPGELNNNGELRHLFSGITSGSRTELIPPTSWGEVLDGATSACRDDKGTNSFYRNLVWFVKKNNRYPVISKTYNNTTGRDVLVIWGIHHPVSVEETKTLYVNSD

SEQ ID NO: 315 - protein, 107 aa, Artificial Sequence; identical to SEQ ID NO: 227
  Description of Artificial Sequence: Synthetic polypeptide

SEQ ID NO: 316 - protein, 107 aa, Artificial Sequence; identical to SEQ ID NO: 228
  Description of Artificial Sequence: Synthetic polypeptide

SEQ ID NO: 317 - protein, 109 aa, Artificial Sequence
  Description of Artificial Sequence: Synthetic polypeptide
PNKICFPGELDNNGELRHLFSGVNSFSRTEKISPNKWGDILDGVTASCRDNGASSFYRNLVWIVKNKNGKYPVIKGDYNNTTGRDVLVLWGIHHPDTETTAINLYASKN

SEQ ID NO: 318 - protein, 109 aa, Artificial Sequence; identical to SEQ ID NO: 230
  Description of Artificial Sequence: Synthetic polypeptide

SEQ ID NO: 319 - protein, 109 aa, Artificial Sequence; identical to SEQ ID NO: 231
  Description of Artificial Sequence: Synthetic polypeptide

SEQ ID NO: 320 - protein, 109 aa, Artificial Sequence; identical to SEQ ID NO: 232
  Description of Artificial Sequence: Synthetic polypeptide

SEQ ID NO: 321 - protein, 109 aa, Artificial Sequence; identical to SEQ ID NO: 233
  Description of Artificial Sequence: Synthetic polypeptide

SEQ ID NO: 322 - protein, 109 aa, Artificial Sequence; identical to SEQ ID NO: 234
  Description of Artificial Sequence: Synthetic polypeptide

SEQ ID NO: 323 - protein, 109 aa, Artificial Sequence; identical to SEQ ID NO: 235
  Description of Artificial Sequence: Synthetic polypeptide

SEQ ID NO: 324 - protein, 109 aa, Artificial Sequence; identical to SEQ ID NO: 236
  Description of Artificial Sequence: Synthetic polypeptide

SEQ ID NO: 325 - protein, 109 aa, Artificial Sequence; identical to SEQ ID NO: 237
  Description of Artificial Sequence: Synthetic polypeptide

SEQ ID NO: 326 - protein, 109 aa, Artificial Sequence; identical to SEQ ID NO: 282
  Description of Artificial Sequence: Synthetic polypeptide

SEQ ID NO: 327 - protein, 113 aa, Artificial Sequence; identical to SEQ ID NO: 239
  Description of Artificial Sequence: Synthetic polypeptide

SEQ ID NO: 328 - protein, 113 aa, Artificial Sequence; identical to SEQ ID NO: 240
  Description of Artificial Sequence: Synthetic polypeptide

SEQ ID NO: 329 - protein, 109 aa, Artificial Sequence; identical to SEQ ID NO: 241
  Description of Artificial Sequence: Synthetic polypeptide

SEQ ID NO: 330 - protein, 110 aa, Artificial Sequence; identical to SEQ ID NO: 242
  Description of Artificial Sequence: Synthetic polypeptide

SEQ ID NO: 331 - protein, 109 aa, Artificial Sequence; identical to SEQ ID NO: 243
  Description of Artificial Sequence: Synthetic polypeptide

SEQ ID NO: 332 - protein, 109 aa, Artificial Sequence; identical to SEQ ID NO: 244
  Description of Artificial Sequence: Synthetic polypeptide

SEQ ID NO: 333 - protein, 110 aa, Artificial Sequence; identical to SEQ ID NO: 245
  Description of Artificial Sequence: Synthetic polypeptide

SEQ ID NO: 334 - protein, 109 aa, Artificial Sequence; identical to SEQ ID NO: 246
  Description of Artificial Sequence: Synthetic polypeptide

SEQ ID NO: 335 - protein, 109 aa, Artificial Sequence; identical to SEQ ID NO: 247
  Description of Artificial Sequence: Synthetic polypeptide

SEQ ID NO: 336 - protein, 109 aa, Artificial Sequence; identical to SEQ ID NO: 248
  Description of Artificial Sequence: Synthetic polypeptide

SEQ ID NO: 337 - protein, 109 aa, Artificial Sequence; identical to SEQ ID NO: 249
  Description of Artificial Sequence: Synthetic polypeptide

SEQ ID NO: 338 - protein, 110 aa, Artificial Sequence; identical to SEQ ID NO: 250
  Description of Artificial Sequence: Synthetic polypeptide

SEQ ID NO: 339 - protein, 109 aa, Artificial Sequence; identical to SEQ ID NO: 251
  Description of Artificial Sequence: Synthetic polypeptide

We claim:

1. A pharmaceutical composition comprising:
   a polypeptide that is a H5 hemagglutinin ("HA") polypeptide having an amino acid sequence, using positions based on the canonical H3 numbering system that:
   i) differs from but shows at least 95% identity with that of a reference H5 HA selected from the group consisting of A/Vietnam/1203/04 (SEQ ID NO: 50), A/Egypt/2786-NAMRU3/06 (SEQ ID NO: 51), and A/chicken/Vietnam/NCVD-093/08 (SEQ ID NO: 69);
   ii) has a deletion at one or more positions selected from the group consisting of: 128, 129, 130, 131, 132, 133, 134, 135, 136, and combinations thereof; and, except for the deletion,
   iii) maintains conserved residues of HA Sequence Elements 1 and 2 as set forth in SEQ ID NO: 106 and SEQ ID NO: 118, respectively.

2. The pharmaceutical composition of claim 1, wherein the H5 HA polypeptide competes with the reference H5 HA polypeptide for interaction with an umbrella topology glycan.

3. The pharmaceutical composition of claim 1, wherein the H5 HA polypeptide amino acid sequence has a deletion of the amino acid residue at a position selected from 130, 131, 132, and 133.

4. The pharmaceutical composition of claim 2, wherein the umbrella topology glycan comprises long α2-6 sialylated glycans.

5. The pharmaceutical composition of claim 4, wherein the long α2-6 sialylated glycans are selected from the group consisting of Neu5Acα2-6Galβ1-4GlcNAcβ1-3Galβ1-4GlcNAc, Neu5Acα2-6GalNAcβ1-4GlcNAcβ1-3 GalNAcβ1-4GlcNAc, Neu5Acα2-6Galβ1-4GlcNAcβ1-3Galβ1-4GalNAc, Neu5Acα2-6Galβ1-4GlcNAcβ1-3Galβ1-4GlcNAcβ1-3Galβ1-3GalNAc, Neu5Acα2-6GalNAcβ1-4GlcNAcβ1-3Galβ1-4GalNAc, Neu5Acα2-6GalNAcβ1-4GlcNAcβ1-3 GalNAcβ1-4GlcNAcβ1-3GalNAc, NeuAcα2-3Galβ1-3 GalNAcα2-6Neu5Ac, Neu5Acα2-6Galβ1-4GlcNAcβ1-3/6GalNAc, Neu5Acα2-6Galβ1-4GlcNAcβ1-3 Galβ1-4GlcNAcβ1-3/6GalNAc, Neu5Acα2-6GalNAcβ1-4GlcNAcβ1-3/6GalNAc, Neu5Acα2-6GalNAcβ1-4GlcNAcβ1-3GalNAcβ1-4GlcNAcβ1-3/6GalNAc, NeuAcα2-6Galβ1-4GalNAcβ1-6GlcNAcβ1-3 Galα2-3Neu5Ac, NeuAcα2-6Galβ1-4GalNAcβ1-3/6GlcNAcβ1-3/6Galα2-3/6Neu5Ac, Neu5Acα2-6Galβ1-3GalNAcβ1-4Galα1-3Galβ1-4Glc, Neu5Acα2-6Galβ1-3GalNAcβ1-3Galβ1-4Galβ1-4Glc, Neu5Acα2-6Galβ1-3GlcNAcβ1-3Galβ1-4Glc and Neu5Acα2-6Galβ1-4GlcNAcβ1-3 Galβ1-4Glc.

6. The pharmaceutical composition of claim 2, wherein the H5 HA polypeptide binds to umbrella topology glycans with an affinity that is at least 50%, at least 70%, at B least 80%, at least 90% or at least 100% of that observed for a wild type HA that mediates infection of humans.

7. The pharmaceutical composition of claim 2, wherein the H5 HA polypeptide binds to umbrella topology glycans with greater affinity than it binds to cone topology glycans.

8. The pharmaceutical composition of claim 2, wherein the H5 HA polypeptide shows a relative affinity for umbrella topology glycans versus cone topology glycans of at least 2.

9. The pharmaceutical composition of claim 2, wherein the H5 HA polypeptide shows a relative affinity for umbrella topology glycans versus cone topology glycans of at least 5.

10. The pharmaceutical composition of claim 2, wherein the H5 HA polypeptide shows a relative affinity for umbrella topology glycans versus cone topology glycans of at least 10.

11. The pharmaceutical composition of claim 2, wherein the interaction occurs between the H5 HA polypeptide and umbrella topology glycans on HA receptors found on human upper respiratory epithelial cells, the bronchus, trachea, or the deep lung.

12. The pharmaceutical composition of claim 1, wherein the H5 HA polypeptide differs from the reference H5 HA polypeptide at one or more positions selected from the group consisting of 131, 132, 133, 137, 155, 159, 160, 193, 224, and 226.

* * * * *

UNITED STATES PATENT AND TRADEMARK OFFICE
CERTIFICATE OF CORRECTION

PATENT NO. : 10,226,527 B2
APPLICATION NO. : 13/253060
DATED : March 12, 2019
INVENTOR(S) : Kannan Tharakaraman et al.

It is certified that error appears in the above-identified patent and that said Letters Patent is hereby corrected as shown below:

In the Claims

At Column 155, Claim 5, Lines 46-47, please delete
"Neu5Acα2-6GalNAcβ1-4GlcNAcβ1-3 GalNAcβ1-4GlcNAc" and insert
--Neu5Acα2-6GalNAcβ1-4GlcNAcβ1-3GalNAcβ1-4GlcNAc-- therefor.

At Column 155, Claim 5, Lines 50-51, please delete
"Neu5Acα2-6GalNAcβ1-4GlcNAcβ1-3 GalNAcβ1-4GlcNAcβ1-3Galβ1-3GalNAc" and insert
--Neu5Acα2-6GalNAcβ1-4GlcNAcβ1-3GalNAcβ1-4GlcNAcβ1-3Galβ1-3GalNAc-- therefor.

At Column 155, Claim 5, Line 52, please delete
"NeuAcα2-3Galβ1-3 GalNAcα2-6Neu5Ac" and insert
--NeuAcα2-3Galβ1-3GalNAcα2-6Neu5Ac-- therefor.

At Column 155, Line 53 and Column 156, Line 14, Claim 5, please delete
"Neu5Acα2-6Galβ1-4GlcNAcβ1-3 Galβ1-4GlcNAcβ1-3/6GalNAc" and insert
--Neu5Acα2-6Galβ1-4GlcNAcβ1-3Galβ1-4GlcNAcβ1-3/6GalNAc-- therefor.

At Column 156, Claim 5, Lines 20-21, please delete
"Neu5Acα2-6Galβ1-3GalNAcβ1-3Galβ1-4Galβ1-4Glc" and insert
--Neu5Acα2-6Galβ1-3GalNAcβ1-3Galα1-4Galβ1-4Glc-- therefor.

At Column 156, Claim 6, Lines 26-27, please delete
 "at B least 80%" and insert
--at least 80%-- therefor.

Signed and Sealed this
Fourth Day of June, 2019

Andrei Iancu
*Director of the United States Patent and Trademark Office*